United States Patent 10,695,415 (LIVE ATTENUATED ORAL VACCINE AGAINST SHIGELLOSIS AND TYPHOID FEVER) - sequence listing, part 3

SEQ ID NO: 1 - DNA, 4795536 bp, Artificial Sequence (residues 3,197,025-4,795,536 of 4,795,536)
  Ty21a-YBC, clone #1-28
ataacgcttcatatggcaaatataccctactaccaccagaacgattaatattatccaataccaggcaataaacatcctttttacccttaaaatttaacatcactaaacatttaacgttaaaattttacatacccttattttgacgtattcatatactggcatatttgtggaacaaataaatgattttgatcatataaatcagtggtgaaacacaataatgaaagaggtattaagcagaaaacaatgtcgataagatcacacttcgtactaatttatattgttcttaaaatatcacactcctactatcgactcactcaggcaattaaaaaatattgatacagaatatactttaaaataagtaacagcatcatgacttatatttaaagaccaatcatttacctcatttattattcataaaaacatagtatattcagaagtattatatttagaagttgtatataaggagatatatccatgtttgaccaataccggaaaacaatacttgccggcgccgtcgcactgacatgcggactcaccgcagccagtacgtttgccgcaggttttcaaccggcgcagcccgcagggaaattaggcgcagtcgttgtcgatccttacggtaatgcccctctcaccgcactggtggaattagatagccatattatttcagacgttaaagttactgtacatggcaaaggggaaaaaggcgttcccgttacttataccgttgggaaagagtctttagaaacctatgacggtattcctatttttggcctttatcagaaatttgccaacaacgtcacggtagaatataaagaaaacggcaaagccatgaaggatgactatgtggtgcagacgtccgccatcgtcaaccattatatggataaccgttctatttcagatctccagcaaacgaaagttattaaagttgcgccaggatttgaagatcgcctttatctggtaaatacccatacctttacgccgcagggcgctgaatttcactggcacggcgaaaaagataaaaatgcgggcattcttgatgccggcccggcgggcggggctttgcctttcgatatcgccccttatacgtttgtggtcgacacccagggtgaataccgctggtggctggatcaagataccttctacaacggccacgatatgaatatcaacaaacgtggctacctgatggggattcgtgaaacgcctcgcggcacctttaccgcggtgcagggccaacactggtacgagtttgacatgatggggcaaattcttgccgatcataaactgccgcgcgggttcctggacgcatctcatgaatccatcgaaaccgtgaacggtaccgtactgctgcgcgtcggcaaacgcgattaccgcaaagaagacggcatacatgttcatactattcgtgaccaaatcattgaggttgataagtctggccgcgtagtagacgtttgggatttaaccaaaatcctcgaccctatgcgtgatgcgctgctcggcgcgctggatgcgggcgcagtatgcgtgaacgtcgatctggcccatgccggacagcaggcgaaactcgaaccggatacgccgtatggcgatgcgcttggcgttggtgccggtcgtaactgggcgcacgtcaactctatcgcttatgacgcgaaagacgactccatcatcctttcttcccgccatcagggtattgtaaaaattggtcgcgataagcaggtgaaatggatactggcaccgtctaaaggctggaataagcagctagccagtaaattgctgaaaccggtagacgatcatggtaagccgttgacctgtgacgaaaacggcaagtgtaaggacaccgatttcgatttcacctatacccaacatacggcatggctttccagcaaaggtacgttaacggtctttgataacggtgatggtcgcggcctggagcaaccggctctaccgaccatgaaatattcccgttttgtcgaatataagatcgatgagaagaaaggcaccgtacaacaagtttgggaatacggtaaagaacgtggatatgatttctatagtcctattacctcggttgttgaatatcaaaaagaccgcgacaccatgttcggctttggcggttctattaacctgttcgacgttggtaaaccaacagtcggcaaactgaatgagattgactataaaacgaaagaagtgaaagttgaaattgatgtgctgtcggataaacccaaccagactcactatcgtgcgttactggtacatccaacacaaatgtttaaataaatcacgggaaggaattaatatgtcatctaaatggattacctctttatttaaaagcgtagtattaaccgcggcattggtcactccttttgcggcatcggcttttaccgagggcacagattatatggttctggagaaaccaattcctaatgcggataaaacgctgattaaggtatttagctacgcctgccctttctgctacaaatatgacaaagccgtaacaggtccggtttctgataaagtcgccgatctcgttacgttcaccccgttccacctggaaacaaaaggcgaatatggcaaacaggccagcgaagtatttgcagtcctgatcgccaaagataaagctgccgggatttcgttatttgatgctaaatcacaattcaaaaaagcgaagttcgcctggtatacggcttaccatgataagaaagagcgctggtcagatgggaaagatccggcggcatttattaaaaccgggctggacgccgcaggcatgagccaggctgattttgaagcggcgctgaaagatcctgccgttcaggagactctggaaaaatggaaagcagcctatgacgttgccaaaattcagggtgttccggcttacgtcgtcaacggcaagtaccttatctacaccaaaaacatcaaatccatcgattctatggctgaactcgttcgggaactggccactaaaaaataagcagggaaacgattatggattttattaagggattatggcgagacctacgcgcaagaccagtggatacgctggtgagatggcaggaacagcgctttctgtggctgttaatggccatcgcgatgggaggattaattatcctggcgcactcgttcttccaaatctacctctacatggcaccgtgcgagcagtgtgtttacatccgttacgcgatgtttgtgatggtaattggcggggtgattgcggcaataaatcccaaaaatattgtgctgaagctgattggctgcatcgcggcgttttatggcagcattatgggcattaagttttctattaagcttaatggtatccatcatgcggtacataatgcggaccccgattcactttttggcgtgcaaggatgttcgactgacccgacctttcctttcaacttaccgttggcggaatgggcaccggagtggtttaaacctaccggagactgcggttatgacgcgcctatcgtccctgatggcgtgacgctcagtagcgtacagcagtggtttgtcgatctctaccagcagtccgaaggctggtatctgcttccgccctggcactttatgaacatggcgcaggcatgtatgttggcctttgggttgtgcctgattctgctgctggtgatgagcggcgcctgggcattgaaactggccagaggcaaataacctgaatagataaaccaaagcagaggtctgcattcaggcctctgcttttctcacaataattttaccattcagcttattcgtcgttctttgaaactgaacaatatggcaccgaaggaatacaaaaaagccgatgagatgtcatcggcttttttcaaccatgatccgttcgatcagctggctttgcgctcatgcgcctggcggtaagccaccagatcttcaatcgtgaccaccgccatattatgctggcctgcaaacgcgatacactccggcgcgcgcgccatcgtcccatcgtcgttagtcaactcgcacagtacacctgcaggtttaaaaccggccagcgtcatcagatcgatggtcgcctccgtatgaccgccgcgcgtcagcacgccgcccgcctgagcgcgcagtgggaaaacgtgccccggacggttaagatcggacggttttgcgccatccttaattgccgcacgcaccgtagtgacacggtcagcggcggaaacgccggtggtcacgccttctgcggcttcaatggtcacggtaaaaccggtgccgtaggcgctggtgttgttttccaccatcattggcaaatcgagctgcttacggcgatcttcagtaatacacaggcaaacaataccgctaccgtgacgaatggttaacgccatctgttctacggtcattgtctctgcggggaaaatcatatcgccttcgttttcacgatcttcatcatcaagcaccatcacaccgcgtccttcacgcagcgcatccagtgcaagttcaacacgttcaaaaggcgtaccaaaagaggaaagtagcgtctgattcatggtaaaaaaacctcattaacattatggttaccagaatcagggcagtcttaggagtgccgacaagcggcaaaaaaataacgtgagcgggtccatgcccgactggatcgttaccctctcccatccggactttaaccgtcggccccggaattacaccggatctgctgaccttttcgctatggcaaaaagcgctcgcgggctttcaacctgctctccgcgttccgtcacggcgcaccgtgatgagaaatgcgttaaacatcgctgatttaccgccggtggggaatttcgccccgccctgagaataagcgggttaactataacgctattgattaccttcatcaacgcctttactccgtatgacatcacacaattctggtttatggcgtccacatatcgcactacaataagagctaacacttaccagttcagggaaaccacaatgattgacccgaaaaaaattgagcaaatcgcacgccaggttcatgagtcaatgccgaaaggtattcgcgagttcggggaagatatcgagaaaaaaatccgtcaaacgctgcaatctcagctgacgcgtctcgatctggtgagccgcgaagagtttgatgtccagactcaggtcttgctgcgcacccgggaaaaactggcgctgctggagcaacgcctcagcgaactggaagctcgcgacaagcctgaagaagtaaaacctgcgcccgccattccgccagtcgatccacaagagtaaaaacgtgaacgggcctgacggcccgctcatataagatctgaataatgccctgcgcctgtataagggagcctgcattagtgttctaattctaactttttcgcctgagtcgcctgctggcagtaaagcgcgtaacgcttgcaaaaccagtcgcggtgctcctcgtccatattgccggttaccgcctggatatcaacaggacgcccctccgcctgcattctggcaaagctgcgcgccagaaaatcgaaattatttaatgaatagacgttattgttgttcatcagcataccctccagttattgaattctgttaaggctatatgctttttctaatttcagtatttccctatatgtacggcggttttatacataacgtgcgcaaatttaatgcgcaaaatcacaatattcaccaaagataacgacggataaatcgcttttcggacttaaggagatatgggtcacatgatattgtaacgcaatgaaataacaagcatgaaaattatcacgcgaacatccttctgaaggcggcgacaaggatagaaaatatgaccttatttgtggagtataacagcccctatctgtttgccatcgcgttcgttttctttatcggcgtgctggagatgatttctctgatttttggccactttctttcaggcgcgctcgacgcccatctcgatcattatgatgccctgtcatccggccctgcgggccaggcgcttcattatctgaatattggacgcgttcccgccctagtcgtcctctgtctattggccggctatttcggcctcttcggtatcctcatccagcatggcgggatcatgctctggcaggcgccgctcagcaatctgctgctggtcccgttaagcattgtcctgtcggtctttgccgtgcattacagcgaaaaaatcctcgcgccctggctacccagagatgaaagctccgccctccgggaagaggaatttatcggcggcatggcgattattaccggccacgccgccgtcgccggaacaccttgcgaaggaaaatttaccgataagttcggccagattcactatttactgctggaacccgaaaagggaaaagaatttaaaaaaggagacaaggtgctgattgtctgccgactttccgcaacgcgttatttggctgagcgtaccttctatgtttaattgagaggaacttacataatggatgatgtttttggcatattgccatcatggatgtttaccgccatcgtggcggttatcgtcttactaattatcgggatcatttttgctcgcctttatcgccgcgcatctgcggaacaggcgtttgtccgtaccgggcttggcgggcaaaaagtggtgatgagcggcggcgctattgtgatgccaatctttcacgaaattattccgatcaatatgaataccctaaaacttgaagtcagccgtgctaccgtcgacagcctgatcaccaaagatcgtatgcgcgttgacgtggtcgttgctttcttcgtgcgtgtaaaaccctctgttgaaggtattgccacctccgcacaaacgcttggccagcgaacgctgtcaccggaagatctgcgtatgctggttgaggataaattcgttgacgccttacgcgctaccgcagcccagatgacgatgcatgagctacaggatacgcgtgaaaacttcgttcagggcgtacaaaacaccgttgcggaagatttgtcgaaaaacggcctggagctggaaagcgtctcattaaccaactttaaccaaacgtccaaagagcatttcaatccaaacaatgcctttgatgccgaaggtctgacgaaactgacgcaggaaaccgaacgccgccgtcgtgaacgtaatgaagtggaacaggatgtggaagtggcggtgcgcgaaaagaaccgcgacgcgcttgaacgcaagctggaaatcgagcaacaagaagcctttatgactctggagcaggagcaacaggttaaaacccgcaccgccgaacaaaacgccaaaattgccgcttttgaggccgagcgccatcgtgaagcagaacagacgcgcattcttgctgagcggcagatccaggagacggagatcgaacgtgagcaagcagtacggtccaggaaagttgaggccgagcgtgaagtacgtattaaagagatcgaacagcaacaggtgacagaaatcgccaaccagacgaaatctatcgccattgccgccaaatccgagcagcaatcgcaagcggaagcgcgcgccaacgacgcgctggccgatgcggttcgcgcccagcaaaacgtagaaaccacccgccagaccgccgaagcggatcgcgccaagcaggtcgctctgatcgccgcggcgcaggatgcggaaaccaaagcggtcgaactgaccgttcgggcaaaagcagagaaagaagcggcagaattgcaagccgccgccatcatcgaactggcggaagcagcgcgtaaaaaaggtctggcggaagccgaagcgcaacgggcgctgaatgacgctatcaacgtactatctgacgaacaaaccagcctcaaatttaaactagcgctcttacaatcgttgcctgctgttattgagaagtctgttgaaccgatgaaatccatcgacggcattaagattattcaggtcgatggcctcaatcgcggcgcgacggcgggcgacgtcgccgctggcggcgctaacgggggaaacctggcggaacaagcgttatctgccgcgctcacctatcgtacccaggcgccgctgatcgattcgctgttaaacgagattggcatcgccggcggctcgctaaaggcgctgaccacgccgttggtttcatcggcaacggatgagattaatcgcgaagcaacgataaaagagcaataacctccccgccatatctcctgtccctggccataaggccggggatttttttatcttttttccaccttgtctgtacaaagcgttatgaccagcaggccattttgcgtgggcgatccagtaacgcaaaatcggcgggagaaagcccttgcgccagacaggccactcaccaacaatcgcgatgtcagcaaggggctgaaacgggaaagcccctcccgaggaaggggctttaataaggaaagggttatgatgcaccaggtcatcatattgattgttctgttactgataagtttcccagcttactaacagccaatcagaggggggagagatcccctctcacccttattcctttactttaggtcgaaaaaaaagcagcgtcaaccgcgagatacgcgtcgaaacaaaatgtccgacgcaccttcaaaatcagcgcccgcagcgtctgtaacgcctgatgacgcggttttacttctcgctctcggtctggatctttttgatgatattggtcgtggaacaaccatcttcgaagttcagcaccatgacttcgccgccgttggcccagacctcttcgctgcccgcgatctcttccggcttatagtcgccgccttttaccagcagatccggcagaataccggcaatcagtcgttgcggcgtatcctcttcaaaagagacaacccagtcgaccgactccagcgcgcccagcacgatcatacgctgttcgagcggattaaccggacggctttcgcctttcagacgtttagtcgaggcgtcactattgaccgcaacaatcaggcggtcgcccagtttgcgcgcgttcgccagataagagacgtggcccgcgtgcagaatatcgaaaacgccgttggtcatgaccactttctcgccacgcttacgcgcgctggcgacggcctgtctcaactcctcttcggtcatgacgccgaagccggtatccgcgcgtccgcgcactgcgttttccagctcaataggggaaaccgttgacgtcccgagtttacctaccactacgcccgccgccgcattggcgaaataacacgcctcctccagggtatttcccgccgccagcgtcgccgccagcacgccgatcaccgtatcgcccgcaccggtaacatcataaacttcctgcgcctgcgtcggcatatgtagcggcgctttattcggttgcagcagcgtcattccctgttcggaacgcgtgaccaacagcgcggaaaggtcgtaatcggcaatgagcttcatgccgcgttcaaccagttcgtcttcgcttttacatttccccgcaaccgcctcgaattcagaaaggtttggcgtcagcagcgtggcgccgcggtaacgttcaaaatccgttcctttcggatcgatgagcaccggcacgcccgcctggcgcgctagggaaatcatagtctgcacgctggtcagagcgcctttggcataatcggacaataccagcgcgccgatcgatcccagcgcctggttgatacgctcatgcaacggctgcgggtccacgccctcaaagccttcttcaaaatcaagacgaatgagctgctgattacgtgatagtacgcgcagtttggtaatcgtcggatgcgtcggcacagaaacgaagtcgcacttcacattgacctccgccagcgttttgctcagcgcgcgcgcggcgtcatcaatacccgtcaggccgaccagacgggcgttcgctcccagagacgcaatgttcatcgccacgttcgccgcgccgcccggacgttcctcaacggtatttaccttaaccacgggcaccggcgcttccggtgaaatacggcaagtggggccataccaatagcgatccagcattacatcacccacaaccatgacgcctgcacgttcaaacgctggcagatttactttcattcctgtctcctgagagattcaaaatttgcgcgcgataatagcataattcaaacggctaccagccacttccgccagcttgcctgcaccagcgcgcgctctttgctaaaacatgtctgcgccacatgaccgggaagctcctgcaacgccaggtggtgcagttcatcacgcagtgtggtgtaggctaccgtcagcgcctgcgcttcgtgttcatccataatgccgttttgcgccagaagctccaggatgcgcacgttatcagaccagcgcgttaatttaggtttttcatgagcgtagcgcagtaccagatattgcgcgataaactcaatatccgtaataccgccttcatcagctttaatatcaaaacgatcgcgatgcttattgccgagatgcgcccgcattttctcgcgcatttcacgcacttcagtctgcaatgtcttaccgtcacgcgccgtcgtcatgatagtgcggcgcaccgcatcaaactgtgaggtaagctgcgggtcgccatataccacgcgagcgcgtaccaacgcctgatgttcccaggtccaggcttcatgctgctgataatcggcaaacgcgtccgctgaagtcaccagcattccagccgcgccagaggggcgtagacgcgcatccacctcatacaaaatgccggaggaggtgcgcgtactgaacagatgcataatgcgctgcgccaggcgcagataaaactgccgcccgtcgatttcgcgttcgccgttggtcatgacgtccatcggacagtcatgcaggaagatgagatccagatcggaactgtagcccagctcccatccgcccaacttgccataaccgacgaccgcaaacccccgcccctggcgttcgtccagatgcgctggctgaccataacgcgcaaccatttgcgtccacgcctgctgcaccacagcatcaatcatcgcctccgccagccatgtgaggtgatcgctcactttcatcaccggcagcgtaccggcaatatccgccgccgcaatccgcaaaagctgtgcctgtttaaactggcgtaatgcctccagttgttgttcttcgtcctcttccggcacgcgcagcaaatactggcgtaattcgtcgcggtaagcgtcggtagccgtcggctgataaagcgtgccggggtcgagcagttcatcaagcaacaacggataacgcgccagttggctcgctatcattggcgaagcggcgcagagcataatcaggtgtttcagcgcgccgggaaattcgctcagcagctccagataggtggtgcgagtgacaatccccgccagcaacggcgttatccgcgatagcgtaacagcggcgtcttcgcgggaacagacgtcagcaagcaggtgcggcatcagttggtccagcacctgccgcccgcgcgggccgatagggcgtttatccagttccttacggaagtcagcgataagggtcagaacctgtcgccgatcctcatcggctaaatgcgccagcactggcgtcgaatcatcctcctgtagcgcatcctgccatacttcacgccacggctctgaacgttcttcctcctgcggggtatcggcttcatcatcgccaattaattcgttgaatacgcggcgtacattagccatatgatccgtcagttcgccaacaagctgcggccagttctccgccttcattccccaggccagccgcgcccgattcagatcgtcggcaggcaacgtttgcgtctgttcgtcattgatgctttgcagcagattctccagacgacgtagaaaaagataggccacgcgtagttgcgccacgtcattctcaggcagcaaatgcagcgcagcgatagcatccagcgtcggcagtaacgaacgcgactgtagcgacggctcgcgtccgccgcggatcagctggaatacctgcacgataaactcaatttcccgaataccgcccgcgccaagtttaatgttgtctttcaaaccgcggcgtcgcacttcgcgggcgatcatccctttcatattacgtagcgactggatgacgctgaaatcgatatagcggcggaaaacgaaaggccgcagcatggcgcgtaattcacgagaccaggcgtcgtcgttatcgcccattagccgcgctttcaccatggcgtagcgttcccagtcgcgtccttgctcctgatagtaatcctccagcgcggcaaaactcagtaccagcgggccgctgtcgccaaacggtcgcaggcgcatgtctacccgatagacaaaaccatccattgtgggctgatccagcgctttgatcagccgctgcccgagacgcgtaaaaaactgggcgttatcgagttcacgacgcccgccccgggtctcgccatgttccggccaggcgaaaatcagatcgatatcagacgaaaaattcagttcgccgccgcccagcttgcccatgcctaaaatcagcagcggctgcggaacgccctgcgggttacagggggttccccattcgcggcaacaggcggcatacagccagtcgcgcgccccgacgatgagcgtctccgccagatggctcaactgttgtaaaatagtctcatcgtccaccagcgacagcgtctgtgcccaggcgatgcgtaccatgatgcgacgacgaaaaagcctcagctcacgcatcagcgaggcgtcgtcacagacacctgccaacgcctcctgtaaccagccagcgtaatgtcgccattcatcagcctgcggcgatgcggattccagttcggcaagccactccggatgcgctatcacgctatccagcgcaaaatcgctaaatgtaagcactgacttcgcctgcgcgctaagcgatgtctcagtaaatccttctggtaggcgctcaacaacggtctgccagtactgcgataagggtgaagagagcggcgtcatttaggggatatcctttaaataatgccggatggcggcgtttcgcctgatccggcctacaagtccgcataccgtaagcctgataagcgcagcgtcatcaggcgctttctacggttctgattatcgttttccgctgtgcaaccagaacggctgctggttgatggcctcattacggaaatgttcaatttcaatacgttgcccggtaataatggcgtgacgcaatccctgccagttttccagccatgcctgcgcgaccatcgcatcataatacccggccagcagtaaaacgctgtcgatatcgcgagtcaaacgcggcaactggtcgcgatacttatcacccagcggttgtccaaaaactttttttaattcagcagcatgacgagaaagatgaatgtcggcgaaacgcttaaaagaatcggccattttggcctgcgccttcgcgtccagaaatggctgccaggctttcgtcaccagccattccgtcaatgccagtttcgccatcgccgtttgcgtactataaacggctgtgacggcggacaccgcggatgtcatcgtcgcttccgcctgggtaagtagatcacgtaagtgagcgctcgctttacgtggaacaatgccaccaaaaagcattaaggcatggcgcactaatcccatagcatccagcacatgttctttcgccgactcgtcgccgcgcagccagagctcttcatggtactgccactgtgacaacgccagatccagcgaggcctccagcccttgctctaccgtagctttcgcggcagtccgcagaattgccgttggtgtattctctcgcggcgcattcccctgcgccaggtgataacctcgcgccgccttactcagactgccctgacgcaaaccggtttgcgacagcagttgcttcgccagttttaacacggcgcgcgtatcgccgcgaagcaactcaagctccagctcacaaattggttcggcaaactcgcccgcttttacgtcgccgagatcgagcgcaatttcaatcctgctgccgtcaacgtccagacaccatttttcccggtaaaaatcggtactgaacagcggctgtacgcttgatgccaggccgtcgggcaggttgccatccggccagacctccgccggaagttgcgtcagatccagcacgggttcgcttagcgcaacattgtattcgggtcgctggtgcagcccgcccgttacccggccggcaattttcatggtcatttcatagcgcccattttcaccacgaatacgcagccccatatcatggcggcgtagccagttatcaggcgtttcgaaatagatattcagcaactggctgggcgcatgatgctcgccgccgagcgtatgaagatgatttcgcagcgcatctacggcgtcgtgattgacgataaactttaattcgatttcctgagccatggccttgtacttatgggttatgtcacatctgggaagattcttggcgaacttacccgcattatttttgtcagtagatagtattttgcgccaaattgccatgcaacgagcaatttgacgggcgtaaaagtttgacgtagcggcaaaggcgacacagatgattccgattgatgtcgactgctttgcgtagcgacactgatgccgttactatcgttccactttctctgacaataacgacagcctgatgccaaaattacgcctgattggactaactttacttgcgcttagcgccaccgccgtctctcatgctgaagagacgcgttacgtttctgatgaactgaatacctgggtccgcagcggtccgggagataattatcgccttgtgggtaccgtcaacgccggcgaggaagtcacgctcttacagagcgatgccaactatggtcaaattaaagacagttctggtcgtactgcctggataccgttaaaagaactgaataccacgccaagcctgcgtacccgcgtgccggatctggaaaatcaggtcaaaacgttaaccgataaactcaacaatattgataccacgtggaatcagcgcaccgccgacatgcagcagaaagtggcgcaaagcgacagcgtcatcaacgggctaaaagaagagaaccagaagctgaaaaacgagctgattgtcgcgcagaaaaaagttagcgccgcgaatctgcaactggatgacaaacagcgcaccattattatgcagtggtttatgtatggcggcggcgtattgggtattggcttgctgttagggctggtgctgccgcatatgatcccaagccgtaaacgcaaagaccgctggatgaactaaatcgccttctctgcggcactgtcttatcattagaggatgatcgtttttaaaaggaaagtggcgtgaagatttatctggtcggtggtgcggttcgggatgcgttgttagggctaccggttaaagataaagattgggtcgttgtcggcgccacgccgcaggagatgcttgatgcgggctaccagcaggtaggccgtgattttcctgtgtttctccacccgcaaactcacgaagaatacgcgctggcgcgtaccgagcgtaaatccggttccggctacacgggtttcacctgctatgccgcgccggacgttaccctggaagccgacctccagcgtcgcgatctgaccattaatgctctggcgcgcgacgatgacggacagattatcgacccttaccacgggcgccgggatctggaggcgcgtctactgcgccatgtctctccggcgtttggcgaagatcccttgcgcgtattgcgcgtggcgcgttttgccgcccgttacgctcatcttagtttccgtatcgccgatgaaacactgacgctaatgcgcgaaatgaccgcggcaggcgagctggaacatctgacgccggaacgggtatggaaagagacggaaaatgcgcttaccacccgcaatccgcaggtttacttccaggtattgcgcgactgcggcgccctgcgcgtcctgtttccggaaatcgacgccctgtttggcgtacccgcgccggcaaagtggcatccggaaattgataccggagttcatacgttgatgacgctgtcgatggccgccatgctcagtccgcagcttgatgtccgtttcgccacgctttgtcatgatgtgggcaaaggcttaacgccgaaaaacctctggccgcgccatcatggccacggcccggtgggcgtgaaactggtcgaacagttatgccagcgtttgcgcgtccccaatgacctgcgtgatttagctaaactggtcgccgcgtaccacgatctgattcacacctttccgatactccagccgaaaacgatcgttaagctgtttgacgccattgatgcatggcgtaaaccgcagcgcgtcgagcagattgcgctgaccagcgaggccgatgtccgtggacgtaccggctttgaagcgtcggattacccgcaggggcgctggctgcgcgaagcctggcaggtggcccaagcggtaccaacgaaagaggtggtggaggccggatttaagggcattgagattcgcgaggagctgacgaagcgacgaattgcagcggtcgccaactggaaagagaagcgctgcccgaaccccgccagctaaacgccatccggcacgataaattgcctgatggcgctgcgcttatcagaccgacaaaactgttaggccggacaaggcggtacgccgccatccggcacggtcaatcatcagaagaagacaacgtaaacggcagccgccaccacaaagcggtaaatcgcaaacggaataaacgagatacgcttaatcagttgcaggaaggtcttgatggcgatcagcgccaccacaaacgccgtcacaaagcccaccgcgaacattggaatatccgctgcggtcaggaatgaccaacttttgtagagatccagaaccgttgcgcccatcatcatcggcacagccagtaagaacgagaactcggaggcggcgtaacggctgacgcccatcagcatcccaccggaaatggtcgctccggaacgcgagaagcccggccacagcgccagacactggaaacagccaatcataaacgcctgacgatacgtcatatcatccagccccggcgcgcgcggttctttcggcttcaggcactcggcggcaatcagcaacagaccgcctaccaccagcgcatacatcacgttaatcgggttaaatagcgacttgatcgtgtcatgaaagactaaccccagcaccaccgccggaatcatgcccagcaggatgtgaatcaacgttaatcgacctttactttcaccttcacgctgtagcgggcggccaaagtgaataccgatgagaccaaacaaccgccgccagaacatcaccacgaccgccagaatagatccaagttgaatcaccacttcgaatgtcttggccgtatcgccttcaaaccccagcagatgacccacaataatcatatggcccgtgctggataccggcaaaaactccgtcaatccttcgaccacacccaaaattgccgctatcagcagcgagtgcatatcgctcatcaataaacccctaaaatgaaaaacactgcaaaaatggatctcgcgttaagaccccatatataaccgtttggtttaaaaaatataaaattatttatttttatttcagattattgccacgctcaataattacccctacgttcgccgcgcgcgcgacggcgctaggcttgctcagtttgatgcgaacccacggagaattgaatcggctaagcagtagatccgccacctcttccgccacacgctcgaccagagcaaaacgcccgccttcaacatgatttatcaccgtgtcggcgatatccgcgtaacttagacaatctgcgacatcatcgcttttcgccgacttgcggttatcccatgccatttcgatatcgaacaccagtttttgctcgatagtctgttcccagtcgtaaacaccgatagtggtgattaccgaaagttgctctataaatacaatatccatcacgacctgcctgctttttggctaacccggataccacttccggcgaaatgtgcgtattatccacagaaatagtaaataaaacgacactttcaatacggaacagcttatgagtgcaatcgcgcctggaatgatcctcttcgcgtacctctgcggctcaatttccagtgccattctggtttgccgcatcgccgggctgcccgatccgcgagaaagcggctccggcaacccgggcgcgacgaacgtattacgaatcggtggcaagggagcggctgtcgcggtacttatttttgacatccttaaaggcatgttgcccgtctggggcgcgtatgcgttaggcgttacccctttctggctggggcttatcgctatcgccgcctgtctgggacatatctggccggtcttttttggctttaaaggcgggaaaggcgtagcaaccgcgtttggcgccattgcgcccatcggctgggatttaaccggcgtcatggcaggcacctggctgctgacggtcctgttaagcggttattcatcgttaggggcgattgtcagcgccttgattgcgccgttttacgtctggtggtttaaaccgcagttcactttcccggtgtcgatgctgtcatgtctcattttgctgcgccatcatgacaacatccagcgtctgtggcgtcgccaggagacgaaaatctggacgaagctgaaaaagaaacgccagaaagattgagctggaactgcgtctggaagagggcctcaaccgtctggggatcggcccacaagggttgaccggcaatagctcggtgataggcgtacatatcgaatccgccgcgcgtcacccttccaccattggcgtggttaggcgcgattttcggcctgattttcctggtgctgctgatcgtctccaggctgttgtggatgcccatcgttttgctgtaaatccgttggggcggcatgatgtcgccccctttttccgcttttacgccgccggcagctcggccagcggccagcgcggacgtaccgttacgccaagatccgccgtaacgcccgccttaaaccgcaccattccggcataggcgatcatcgccccgttgtcggtacaaaattccgggcgcgcatagaacacttcgccgcggcgtttttgcatcatttcggcaagcttcgcacgcagcgtgcggttagcgctgacgccgcccgccatgacaagacgcttaaaaccggtgctttccagcgcgcgcttgcacttgatcatcagcgtatccacgaccgcatcttcaaaagcgcgcgcgatatcagcgcgagtttgttcgtcgtcgccattactacgaatggtgttagcggcaaaggttttcagaccggaaaaactaaaatccagccccgggcgatcggtcatcgggcgcggaaagacaaaacgccccgccgtcccctgcgacgccattttcgacagcatcgggccgccaggataatccagccccaacaatttggcggttttatcaaacgcttcaccggcggcatcgtcaatcgactctcccagcagttcgtactgaccgattccggtcacgctaatgagctgcgtatgtccgccggagaccagcagcgccacaaacgggaaatccggagggttatcttccagcattggcgccagcagatgaccttccatatggtgtacaggaatggctggcacattccaggcaaatgccagcgaacgcccgacggttgcgccgaccagcagcgcgccgaccaagcccgggcctgcggtataggccaccgcgtcgatatcgctcgccgtcagagcggcttcttttaatgccgcctgaatcagcggcacggttttacgcacatgatcgcgggaagccagttcaggcactacgccgccgtaatcagcatgtaatttcacctgactatacaattggttggctaacagaccttttttgtcgtcgtaaatagcgatgccggtttcatcgcaagatgtttcaatacccagtacacgcatgacttgttttacctcgctctaataccgcgcagtgtaggtcgaatgcgggtggatgtataccctcagtcccgacttcgtgtatactccctccccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgacgaccgaacgtaagcgcgctaaagcttctgcagtgaaacgtcacgcgaagaaactggctcgcgaaaacgcacgccgtactcgtctgtactaatcttttgagagcgggctgctctcaattcagatcgagttgtagttgcaaggccgtgcttccgaaaggaatgcgcggcttgttttcgtttatgcattagcatatacacaaaatcattcatgctacgtccaggcggcaagagagcaagtccccggcgcttacgcaagtcagcgacaggggtgagcaaacgtagccaacactacggcagcctgaagaatgacgtgtataaaaggggcatatggctggacgaatcccacgcgtatttattaatgacctgctggcgagaaccgatatcgtcgatctgatcgacgtgcgcgtaaaactcaagaaacagggcaagaactatcacgcgtgttgtccattccataatgagaaaaccccttctttcaccgtaaacggtgaaaaacagttttatcactgctttggatgcggcgcgcatggcaatgcgatcgactttttgatgaattacgacaagctcgaatttgtcgaaaccgtcgaagaattagcggccatgcataacctggaaattccctatgaagcaggcaccgggcttagccagatagagcgccatcaacggcaaaacctctatcagttgatgaatggtctgaatgacttttatcagcagtcgcttacccatcctgcggcaaaacctgcgcgtgactatctgcaaaagcgcggtctgagcgctgaaattattcagcgtttcgccattggcttcgcgccgcctggttgggataacgcgttaaagcgcttcggtaataacagcgataacaaggcattgttgctggatgccggaatgctggtcaataacgagcagggcagcacttacgatcgtttccgtaatcgggtcatgttccctattcgggacaaacgcggcagggtgattggttttggcggtcgagttctggggaacgacacgccgaaataccttaactctccggaaacggacattttccataaaggccgccagctatatggtctttatgaggctcagcaatatagtgctgaaccgcaacgcttgcttgtggtcgaaggttatatggatgtcgtcgcactagcgcaatacgacattaactatgcggtcgcctcgctgggtacctcaaccacggcagaccatatgcatatgttattccgggcgacgaacaacgtaatttgctgttacgacggcgaccgggctggccgtgatgccgcctggagagcgctggaaacagcaatgccttatatgaccgacggtcggcaggtacgctttatgtttttacctgacggcgaagacccggatacgctggtgcgtaaagaaggcaaggcggcttttgaagcgcggatggagcaggcgcagccgctctctacgtttctgtttaatagcctcctgccgcaggtggatttaagctcgccggatggcagcacgcagttagccgcgctggcgctgccgctcattaatcaggtgcctggcgacacgcaccgtattcagctgcgccagacgttggggctgaagttaggcattttcgatgatagtcagcttgatcgtttagtgccaaaacaggcggaaagcggcgtttcccgcccggctccgcagctaaaacgcacgaccatgcgtatactgataggattactggtgcaaaatccggatctcgcgccgttagtgccgcccttagacgcgctggatcagaataagctgcctggacttggcttatttaaagaattggtcaaaacttgtttggctcagccaggtcttactaccggacaacttctggaactctaccgtggcacaaatgatgctgcgacccttgaaaaattatcgatgtgggacgatatagcagataaggcgattgccgaaaagacctttaccgactcactcaaccatatgtttgattcgctgctgcaactgcgacaagaagagctgatcgctcgcgatcgcactcacggtttaagcagcgaagaacgccgagagctctggacgttaaaccaggagctggccagaaaatgaatttaacggcttaaatgccgcatatcgttcgggaagcccccgacagccgcagtgagaggcagcggccaaaatataagtatgccctcgctttaaatgtcgacagctataccgtcgacaccaatcaaacgaataagtgtggataccgtcttatggagcaaaacccgcagtcacagctgaaacttcttgtcacccgtggtaaggagcaaggctatctgacctatgctgaggtcaatgaccatctgccggaagatatcgtcgattcagatcaaattgaagatatcatccaaatgatcaacgacatgggtattcaggtaatggaagaagcgcctgatgccgatgatctgctgctggctgaaaataccaccagcaccgatgaagatgcggaagaagctgctgcacaagttctgtccagtgttgagtctgaaatcggtcgtacgactgacccggtacgcatgtatatgcgtgaaatgggcactgttgaactgttgacccgggaaggcgaaatcgacatcgctaaacgtatcgaagacgggatcaaccaggttcaatgctccgttgccgaatacccggaagccattacctatctgctggaacagtacgatcgcgttgaggctgaagaggctcgtttgtccgatcttatcaccggctttgtcgatccgaacgcggaagaagagatggcgccgaccgcaactcacgtcggttctgaactctcccaggaagacctggatgatgacgaagacgaagatgaagaagacggcgacgatgacgccgccgatgacgacaacagcattgaccctgaactggcacgcgaaaaattcgctgaactgcgcgcgcaatacgtcgttacgcgcgacaccatcaaagcgaaaggccgcagccatgctgccgcgcaggaagagattctgaagctgtctgaagtgttcaaacagttccgtctggtaccgaagcaattcgactatctggtcaacagtatgcgcgtgatgatggatcgcgtgcgtactcaggaacgtctgatcatgaagctctgcgtcgagcagtgcaaaatgccgaagaagaactttatcacgctgtttaccggtaacgaaaccagcgaaacctggttcaatgccgctatcgcgatgaacaaaccgtggtcggaaaaactgcacgatgtcgcggaagaagtgcaacgctgcctgcaaaaactgcggcagatagaagaagagaccggtctgaccatcgaacaggtgaaagacatcaaccgtcgcatgtccatcggggaagcgaaagcccgccgtgcgaaaaaagagatggttgaagcgaacttgcgtctggttatttctatcgccaagaaatacaccaaccgaggtctgcagttcctcgatctgattcaggaaggcaacatcggtctgatgaaagcggtagataagttcgaataccgtcgtggttacaagttctccacctacgctacctggtggattcgtcaggcgatcacccgctctatcgccgaccaggcgcgcaccatccgtattccggtgcatatgattgagaccatcaacaagctcaaccgtatttctcgccagatgctgcaagagatgggccgcgagccaacgccggaagagctggctgaacggatgctgatgccggaagataaaattcgtaaggtgctgaaaatcgccaaagagcctatctccatggaaacgccgatcggcgacgatgaagattcgcatctgggtgatttcatcgaggatactaccctcgagctgccgctggactctgccaccaccgagagcctgcgcgccgccactcacgacgttttggctggcctgaccgctcgtgaagcgaaagtcctgcgtatgcgtttcggtatcgatatgaacaccgaccacacgctggaagaagtgggtaaacagttcgacgttacccgcgaacgtatccgtcagatcgaagcgaaggcgctgcgtaaactgcgccaccctagccgttctgaagtgctgcgcagcttcctcgacgattaattcgccgtacacgtataaacgccgccgcaaggcggcgtttttttatcaggtcatgcgcgagcgttctatttggcctgcagaatctctacacaacgcgagtattcgcgccctcattccccattgctatagcccacgcataatgagcgcttgatccagctcgcgataggcctcgaccagtttttccgttttaattcggtttaagccgctgggattcggcaacacccacaccatcgtcgcgccaatggcgatcttttgtttaccccaggcgataccgcgctggctgaatccctgttcaaaagcctgtttaccaagcaccgccagcgccgcgggctggtagtcctctatcttttcaatcaggttgcgtccgccgctacgtaattcatgcaacttcacctcagtcgcttgtaccgtcggtcggtcgacgagtttcgttaccccgcagcgaaaatccagtaatttttccgcctcctccggtttcaactgtcgatcggtgaaaccggccaaatgaataactttccaaaaacgattcgcgggatgcgcaaacggaaagccggtattcgccgaggagagtcccggattgatgccgcaaaaaaccacccgtagccctggcgccagtatgtccttaaccattattactcctgagcaatacaacgttctttaagtataacgggttgaaaacacattgtttataaaaacagcacccgcacggttacggctggattacagcgtaaagttacattataatccaccgccacggccccttagctcagtggttagagcaggcgactcataatcgcttggtcgctggttcaagtccagcaggggccaccaaattttagctttaaaatcatataattaagccactctaaagagtggcttttttgtttctgacagggctcgccccataccgctatttacgatgccaataggctgccgcacgtaccaggtgtggatcaaaccccttttcaaagcactgacttaaacgttttaccgttttgccttcgccagtaatccagatgaaatagtctgattctggtattgccagctgcgacaggcgcgtttgcattgcctgttcatcgccgccaacaacatattccacagtaatatccgtcaaatgggcgagataatcgcgatatgcggcatcctgaatgctcaccagcgcggttaccgcagggcgcgcaggcagacggctaagcgattccagacgacgacgtagcgcaggcataccggactcatcgcagacataaacctgacaagcataatcttccggcaccaccagcgaaccgcgcggcccgccaatcgtcagtgtatcgccttcacgggcttccattgcccaacggctggctacgccgccatcgtggataaagaaatccagcgccagctcgcgatgcgcctcgtcatacagcggcgtgtaatccctggagaccggacgaacgccctccccccagataatgccttcctcagtgactgtcgggggcgtaaagcgacagcctggctcagggaaaaaaactttcgtgtgatcgtcaaagcccagggaggtgaaaccgtccagcgcctcgccgccaagtacgatccgctgaaatcctgcgctaatacgttctacccgcagaacggtcagctcgcgaaaacgcagttcattacgaacacgctgtggatagcgtgcggatgatgtcgtcattttttgccttcgtgaagtaatacgatatatctaaattaaagttttaaatgataatgattgttaatcagtaaaaatgcaactgttttttgatagtgttctggcaacgcgtagctaactataaccttaagataaaaccttataaattaatagattatagcaaaaatggcttttacccttgctaaaacccatcatttagatataaattagatatatctaaataagcaggagacaatgatgcaaaatcaacatgaagggtgttgcaaaaaccaggatcataagcacgacggctgctgtaaagatcgagaacatcagcatgaaggctgccatagcgcgcatcagcatgagaacgccagttgcggcggcgaacatcgtcacggacacggctgtggtcgtcatggacagggcggtggtcggcgtcagcgattttttggccacggggaacttcggctggtcattcttgatatcctgacccgggacgccagccacggctatgaactgattaaagcgatagaaaacctgacggggggcggctatacgccaagcgctggcgtgatctaccctacgctggattttttacaggatcagcaatttatcacgattagcgacgaagaaggcgggcggaaaaaaatcgcgattaccgcgaacggcgcgcaatggcttgatgaaaatcgcgaacatctgacgcatattcaggcgcggctaaaagcccgttgtgtgggcatggagttacgtaaaaatcctcagatgaagcgggcgctggataacttcaaggccgtgctggatctgcggataaaccacagcgatatcaacgacgcgcaaatcaaacgcattatcggcgtgattgatcgcgcggcgctggaaatcgccgaactggattaagcgggctgcgtgtcctcttcgcggacgcggaacacgttaaccagctcttttaaatgtaacgcctgttcgttcagcgacgctgcggcggcaacagactcttccacaaggcaggagttttgttgcgtggcggcgtcaatcaggccaatcgcgctgttaatctgcgaaataccgtcagtttgctcgcggctggcctgcccaatctcacgtaatatcacatccatctcttcgacgttgtccaccatgccattaatcagggcgctggctttctccaccaggtgcatcccttcctgagtctgactggttgaatcttcaatcaaattacggatttcactggccgacgaggcgctcttttgcgccaactggcgaacctctccggcgacaacggcaaaaccgcgcccatgttcgcccgcgcgcgccgcttcaaccgccgcgttcagcgccagaatattggtctgaaaggcaatggaatcaatgatattgatgatatccgacatacgatttgccgtatcgttaatgacgcgcattttctgcgtcacttgattcatcatctccccattgtttttcactacgctggcggcgccagcagagagtttggtcgcttcactggtatgatcggctgtgtttttaaccgtggcggtaatctgttccatcgacgccgccgtttcttcaaccgagctggcctgctcttccgtacgcgccgccaaatcctggttaccggcgacaatttgcgccgccgccgtggagatactctccgaaccgttttgcacttcctgtacgatatccagcagacgcgttttcatcgccattaacgcttgcagtagtacgcctgtttcatctttatagtcggtggtgatatggcgagtcagatcgccatcggcaatcgcctcggcaaagcgtaccgcgtcatcaagcggtcgggtaatagaacgcacaatataccatcctattacgcctccggcggcgatgcttatcagcgccaaagtgattaacaacgtccgattatttttaaaatcctctttgacctgcacgctcgctttatgcatcagcgcgtcctgaacagcgataagttcctggactttgtccttatagactttttgcacctgcaccgttctggtcatcatctcctgaatggccgcctgacgattattgctttgaatatctttcaaaatacggaatctggactccaggtattgctggcgcgcttcacggatttcattaatgattttctgtgaatccgcatcgtgactattttccctggaaagctcatccagtaacgccgaaatgcgctggcttatctcactgagttctttctgcgagctctggctccagcgcccctcttcatccagtaacatgagctgctgcgcgatgatgaaatcattaaaattatcgattaacagattggcttttaccgtggtgggataatcattggtaataatgtcctgcatacccgtattagcccgatcaaggctaaacaaagacagagcggaactcaccaccatgagaacaatgaataagccaaaggccataaataattttgaacgtattttaatgttatgcaaaaacatattttctccctgggatcgcatatcctcatacaggaagatttatcggcaataatgttactaactttatgatattgatcgctttttatttcggaacattattagtaattaatatttattgttcacagaaagatgaaccaaaagtgacataaattggcactaataatgaaagaaatacgctaaaaggttaaccatttcttatttatcaactgagtttatacctattaataggtagacaagggagaaggaataaatatcacattatttttaacatcacaggccactggtactctctatgatggcaggcaccgccttctatcagagcacatccgcccggtaagcttgttgctaccgggcggatgtcattaccgttgctacctacaaataaacttaatgcagtaccgtgaccgcatcctccagccggctggcacggtgttttaccatcgcggagacttgtgcgctctcttccaccagcgccgcattcttctgggttatgcggttcaactcgtccacggcgcgagtcaggctggaaagcccatctgtctgttcctgcgtcgactggctgatccgtgcgataagcagggtgacattttgcacctgggctacaatgtcatccatggtacggcctgcggcgtgaacctgctcggagcctgactgcacctttgttgcgctggcatcaattaatttacgaatatcgttcgccgcgttagcgctgcggctggcaagatggcgtacctcgccagcaaccacggcaaaccctttcccctgctcgcccgctctcgccgcttctaccgccgcattcagcgccaggatattcgtctgaaaagcgatatcgttaattagcgtggtgatcgtcccgatacgttgcgtactgtgagcgatatcatccatcgttttaatcaccgtatccatcgcctcacctccctgagtcgccgcgctactggccgccatggaaagcttatccgcagcggaagccgtctcggaattgagcttcacggactccgccatctggttcatggtcgttaccgtttcctgaacattctccacggtctgacgggtgtgttcgttcagatcattgttacccttcgccagcctttcactgccgtttctgacgctggacacctgacttgatacgtcattgatcagccaacggcacatcaagccaagctgccccacggccctcagcgtcagccccaactcatcgctacgattaaggtgttgtacgctgttgcgttcgccggtcgccactttcagcgcctgcgtcgccacattttcaatgggacgcacaatttgccattcaaatagcgccgtacctgccagcatcgccaacgcgcccaacaacaacgcctgccatgaggcatccgtaccgaacagcgccaacgccagcattacggccattagccccataatgctacgcactcgccagcgaacaggcatcgcgggcagtttgcccagcaagccctgacgaaccaccaggcctttatgaatacgtttactacaccgcccttcatttagcgcctgatataaaggctcgacggcggcaatctcatcatccgtggcgcgggtacggatcgacatatatcccgtcacacgcccttcacgtatcatcggtaccgcgttggcccgcacccaataatgatcgccgtttttacgccggtttttcacaatgccgctccacggttcgccctgttttagggtgtaccacatatctgcgaaggcagctttcggcatatccggatgacgcaccagattatgtggccgcgccagtaactcgtttaactgatagccgctcacctggacaaaagtgtcattggcgtgagtgatatagctttccaggtcggtcgtagacatcagagtggtatcatcatccagcggggtatttagctggctgacgtagggatgagaagacatgatagcgtcctgtgcaggttatctggatgttaatttttcgctcagatgttatttcggcgctaatctatttatctttagttgttaaaattgctctggatcgcaatttgcgattaatccttaatatttgtacgattttcaccttatcctgcgccttattttcattatgaaattgtttagcgtggacaacctttttctttaaaatctgccctggctcacctttttctcacgccgccgctaacgcaacacaccgtaaaccgtaaaacaagatctgctcaaaatgcatccaattgttaacgtataacattaaatgttgtgtaaatgtgattattcctggtgtttatcccgattttcactatgggcttagacccccgctaatccctgcaatacttaattcagtatcatgtgatacacggctctctggagctcattttgaacaggttaccttccagcgcatcggctttggcctgtagcgcgcacgcactgaatctcatcgagaagcgaacgctaaaccatgaggaaatgaaagcactaaaccgagaggtcattgactactttaaagagcatgtaaattcaggatttctggaataccggaaatctgttaccgccggcggggattacggagccgtagagtggcaagcgggcagtttgaatacgcttgtcgacacccaggggcaggagtttatcgattgtcttggggggtttggcatctttaacgtggggcaccgtaatcctgttgtggtatccgccgtccagaatcaactcgcaaaacaacctctccacagccaggagttacttgaccccttgcgggcgatgctggcaaaaacgctggcggcgctaacaccggggaaactcaagtacagctttttctgtaacagcggcaccgaatccgtcgaagcggcgctaaaactggcaaaagcgtatcagtcgccgcgcggcaagtttacctttatcgccaccagcggcgcatttcacggcaaatcattgggcgcgctctccgccacggccaaatccaccttccgcagaccctttatgcctttactgccgggcttccgccatgtgccgtttggcaatatcgacgcgatgagcatggcatttagcgaaggcaaaaaaacgggcgacgagatagcagccgtgattctggagcctattcagggtgaaggcggcgtgatcctgccgccgcagggatacctgacagaggtacgtaagctctgtgatgaattcggcgcgctgatgattctggatgaagtacaaaccggcatggggcgtaccggcaagatgtttgcctgcgagcacgaaaatgtgcagcctgatattctgtgtctggcgaaagccctgggcggcggcgtgatgccaattggcgccaccatcgcgactgaggaggtgttttcggttctgttcgacaatcccttcctgcataccaccacttttggcggtaacccgctggcttgtgctgccgcgctggcgaccattaacgtcctgctggaacaaaacctcccggcccaggcggaacaaaaaggcgatacgctcctggatggttttcgacaacttgcgcgtgaatatcccaatctggtacacgaggcgcgcggcaaaggtatgttgatggccattgaatttgtcgataacgaaacgggctaccgttttgccagtgagatgttccgtcaacgcgtgctggtcgctggtacgctgaataatgcgaaaacaattcgtatcgagccaccgctcacgctaaccattgaactgtgcgaacaggtattgaaatcagcgcgtaatgcgctggcggcaatgcaggtgagcgttgaagaggtttaaaaacgatgccggatggcgctgtgcttatccggcctgttttccccgggtcgcggcctcttttttgaatcccatcacaatcaccacattccccttttcccttttacctcgcgacggctacagtagtaactcatccgaccacataacaataattttacatactggatacgcttatgagctacccgtcgctgttcgccccgctcgatctgggctttactactctcagaaaccgtgtgctgatgggatcgatgcacacgggtctggaagaacatcctgatggcgctgagcgcctggcggcattttatgccgagcgcgcgcgacacggcgtagcgttaatcgtcaccggcggtattgcgcccgttccctccggggtcgtgatgaccggcggcgcgatgctgaacgatgccagccagttaaagcctcaccgcgtggtgaccgatgccgtacatgcgcaaggcggtaaaatcgcgctgcaaattctgcacaccggacgttacagctatcagccgcacctggtcgcgccgtcggcaattcaggcgccaatcaaccgctttatgccacatgaactgacgcatgatgaaatcttgcagttaatcgacgacttcgcacattgcgcgcagctggcgcgggaagcaggctacgacggcgtagaggtgatgggatcagagggctatctgattaatgaatttctcacgcggcgaactaaccatcgcgatgacgaatggggcggcgactataccagtcgtatgcgcttcgcggttgaggtagtacgcgcggtacgccagcgggtagggaacgactttattattatctatcgcctgtcgatgctcgatctggtggaaaatggcggcacgttcgacgaaacggtacaactggcgcaagccattgaagccgcaggcgcaagcctaattaataccggcattggctggcatgaggcgcgaatcccgaccatcgccacgccagtaccgcgtggcgcctttagctgggtgacacggaaactcaaaggtcatgtgtcggttccgctgatcgcgaccaatcgcattaacgatccgcaggtcgccgagacgatcctgacgcgcggcgatgccgatatggtgtcgatggcgcgtcccttccttgccgatgctgaattcctgactaaagcgcaatccggacgcgcagatgagatcaatacctgtatcggctgtaatcaggcctgtctggatcggatcttcatcggcaaagtgacctcctgtctggtgacccacgcgcctgtcacgaaacccacatgccgataacgccggccatacgcaaaaagaatctggccgttgtcggcgcaggcccggcggggctggctttcgcgattaacgccgcgtcgcgcggccatcatgtcacgctgtttgacgcccagagtgaaattggcggtcagtttactatcgccaggcagatcccgggtaaagaagagttttacgaaacgctgcgctactaccgtcgaatgatcgatgttactggcgttacgctgaaactgaaccaacgggtgaacgcagaggatcttcagccgtttgacgaagcgatcctcgcctgtggaatagtaccgcgccgcccgccgatagacggtatcgatcatccaaaagtattgacctacctggaggtattgcgcgataaagcgccggttggtaagcgagtggcgatcatcggctgcggcgggatcggttttgacacggccatgtatctgagccagcacggcgaatccaccagccaaaatattgctgaattttgtacggaatggggaattgataccagcctgcaacaggcaggcggtctgcgcccggaaggcccgcgcctggcacgtagtccacggcaaatcgtcatgctgcaacgcaaagccagcaagccgggcgaagggttaggtaaaaccaccggctggatccatcgcgcgacgttactggcgcgcggcgtgaagatgatcccggcggtcagttactagaagatcgacgacgacggattacatctcttgatcggcggcgaaccgcagttgctggaagtggatcatgtggtgatctgcgccggacaggaaccccgccgtgaactggcggacccgttacgcgccgcaggtaaaacggtacatcttatcggcggatgcgatgtcgcgatggaactggatgcccgacgggcgattgcccagggcacccgactggcgctggagatttaacgactttgcctgatggcgctgcgcttatcgggcctatgccgtcataccggttttataggccggtatgacgcttgagtgccttatcgacggcgtccctgcttcaccgctttcagaataacaaatttattgttggttgctatcgtcgcgcaattaccgaaaatcttcttcagcttgtggaaatagtccagatggcggttcgccacaatatacagttcgccgttgattttcaggcagcggcgggcatgatggaacatctcccaggcgatattatccgtcagcgcatgtttctggtggaacggcggattgcagaacaccgcgttaaaacggaacggctccacgccggagagcgcgttgttgatcataaattcgcagcgttcgaacgcttccggcaggttcgtttctacattcaaacggctggaatctaccgccatcggcgattcatcgacaaataccacgttcgcctgcggatttttcgccagtaagctcaggccaatcaccccattgccgcagccgagatcgacaatctccccgtcgaggttttccggcaaatgctgcataaagaagcgcgcgccgatatccaatccggtacgagaaaacacattcgcgtggttgtgaatcgtccagcctgtatcttccagtttccagcttagcgtttgcggcgcgttggccagttgcggatgactgaaggtacagttaatcaggcgcgctttcttccacgccagcgtcgtcgtggttgggcccagcactttttcaaacagttccagcgtagaggtatgaatatcacgcgctttcgcgccggcgataatacgcgtttgcgccgtaacgaccttacgcaaagcgcgtaactgctgttccagcaacgccagtgttttcggtactttaatcaataccacgcccggtgcctgcgggtagtcagcggtactgtcgagaaacgttacgctggactccgcgatgccgttatggcgtaaattctctcgcgtacccagttcgcttaaatatgaatcgccaatactgtatggcgaatgctccgccagcgcacagcttagcgcgccaaacgtatcattcaggatcagcaccgggccgcgaatttccgtctcatccaactgttgcagcagatactcatcggccgcctcccacgccagaagcgggttaacatcatccgtttgcggaaaacgtttcagcgtcagtgaacggaaaccgtcgtctacgtggctcattaggcctcctgaatggtaaaattgcggcgttatccctgaaaagggtgcgtgagtatacactttttatcggcaacatggagctttgatgacctcactaacttaccttcaggggtatccggaacatctccttgcccaggtgcgcgccttaatcgccgagcagcgcctgggggcggtgctggaaaaacgttatcccggcgcgcatgattacgctactgacaaagcgctatatcactatactcaggaactgaaaagtcagtttctgcgcaatgcgccgcccatcaataaagtgatgtatgacagcaagatccatgtgctgaaaaatgcgctgggactgcataccgctgtctcgcgcgttcagggcggcaagctcaaggccaaggcggagatccgcgtcgccaccgtgtttcgcaacgccccggagccattcttacgaatgattgtggttcacgaactggcgcacctgaaagagaaagatcataacaaagcgttttatcagctctgctgccatatggagccgcagtaccatcaactggaatttgatacgcgcctgtggctgacgcatcaggcgctgtcggcacaataaattctgaaaatgccccttcccccgtatctttttaacggcgtgggcataaaatcgacgcgttcacatttcgctcattgcctgccgccacctcaaggatgacgatctgtagagggtattttttatccaccgccaacggaaccgcgcaacaaccatgctctcacaatgtgcccgttttatccgccgcctctgttttacacgccgggcgttaacagtggcgtgttttctgcttgtcgcagcaggcgtcgcgcttttctattccaactggcttatcgtcaacgcctcacagcatctgacatggaatgacattcagaccgttcccgcccgcaatgtcgggctggtattaggcgccaaacccggcaatcggtattttacccggcggattaatactgccgccgcgttgtaccacgccggtaaagtgaagtggctgttagtcagcggcgataacggcaaaaaagagtacgatgaaccttcggcgatgcagcaggcgctgatagcgaaaggtgtgccggaagcggccattttttgtgattatgccggattctccacgctggactccgtggttcgcgcccggaaagtgtttggcgaaagccgcattacgattatctcgcaagcatttcataatcaacgggcgatctggctggcgcaacaatatggcattgacgctatcggcgttaacgcgccggatctgaataaaaggcacggaacctacacacgacttcgggaaaagctggcgcgggttagcgcagtgctggatgccaaaattttgcatcgtcagcctaaatatctgggcgctggcgtcactattggggctgatagcgcacacgggtgcccttctcgccagtaaaatgccagagtgcgtcgcagcgcactggcaagggcggaaaggcgtgctacattgacgaaaatccctttctggagtccgctgacgtttatgatacgtttcgctgtaattgggactaactggatcacgcgccagtttgtcgacgccgcccatgaaaccggcaaattcaggctcgccgccgtttactcccgtagacttgaacaggcgcagtctttcgcaaatgattatcccgtcgagcatctgtttacctcgctggaagcgatggcgcaaagcgacgcgattgaggcggtttatatcgccagcccgaattccctgcatttctcccagacgcagcgctttttgcagcataaaaaacatgtcatgtgcgaaaagccgctggcttctaacctggcggaggttgatgccgctatcgcctgcgcgcgcgataatcagcgggtactgtttgaagcctttaaaaccgcctgcctgcccaatttcctgctgctgcgggaatcgttgccgaaaatcggcagaatgcataaagcattactaaattactgccagtactcttcacgttatcagcgctatctgaacggtgaaaatccgaatacgtttaatccggccttctccaatggttcgattatggatatcgggtattactgtctggcgtcggcgatcgcgctatggggcgagccgcgcagcgttcaggcgtcggcgaatttattggaaagcggagtagatgcacacggcgtcgtggttatggattacggcgattttagcgtcacgctacagcattccaaagtcagcgactcggtactggccagtgaaattcagggcgagaggggatcgctggtcattgaaaagctgtcggaatgccagaaagtgtgttttgcgccgcgcggcgcgctgatgcaggatctgacccagcctcagcatattaataccatgctgtatgaagccggggcgtttgcccagcttattgaaaaccacgccgtggaacatccggggttgtcgctaagtcgcgccacggcaaaatggctgacagaaatacgccgtcaaaccggggtcatcttcccggcggacgatctgactcatccccctactgcgtaaaattatgtaaatcgtatgttacaggtcattgactctacgcgtggcctgtcatactttgttacgcgcaaaggggagtaacttcattgccggtcgatcgtcattacgatgtgtgcaaaaccacatccggtcaccgggcagccataaaggaatgcgtcagcgtattcctttattgttgtaagtgagaccttgccgaatggcaaggtctatgcataaaagcagcggctaatgccattcggcattagtcgtttttttgcatggggagaaataatgaatactgttggtacgccattattatggggtggattcgcggttgttgtggtgataatgctatccatcgacttgttgttgcagggacgccgtggcgcacatgcgatgtcgatgaaacaagcggcaggatggtcaatcctgtgggtaacgctctcgctactgtttaacgccgctttctggtggtatctggctgaaacgcaagggcgcgaagttgctgacccgcaggcattagcgttccttaccggctatctgattgaaaagtcgctggccgtagataacgtctttgtctggctgatgctgtttagctatttctccgtccctccggctctgcaacgccgggtgctggtgtatggggttcttggcgcgatcgtgttgcgtactatcatgattttcgccggtacctggcttatcactcagttcgaatggctgctgtatgtgttcggcgccttcttgctgtttaccggcgtaaaaatggcgctggtgaaggaagacgaatccggcattggcgaaaaaccgatggtgcgttggctgcgcgggcatctgcgcatgactgatacgatcgagaacgagcactttttcgtacgtaaaaacggcctgctatatgccacgccgctgctgctggtgctgattatggttgagttcagcgatgtgatcttcgccgttgacagtattccggcgatctttgcggtcaccaccgacccgttcatcgtactgacctctaacctgtttgccatcttaggactgcgcgcgatgtacttcctgctgtccggcgtggcggaacgcttctcgatgctgaaatatggtctggcggtcattctggtctttatcggcattaagatgctgatcgtcgacttctaccatattcctatcgcgatttcgctgggcgtagtgtttggcattctgaccattacgctggtgattaacacctgggttaaccatcagcgcgataagaaactacgagcgcaataatcttttatcggggtaaacctgccccatcaaaaacgcccggcagcgtacacctgccgggcgtttttgtttaacatgtcacaatactgttaatataaagttataaaacatgatcacagcaaaaaatccaggatatttcgcttcccgaaccttcaactttccttatactcaaccaggcaaacactttgttacatcctgaaagatgcgccgtaagagcgtgcaggggatgaccagcaacacaatacaaggaatatgaaatggctacgcaacgagcatcagggctactgcagcgtttagcgcaaggcagtctggttaaacaaattttagtgggtctggtactggggattttactggcatggatttctaagcctgtggcagaagcggttggcttgcttggcaccctgttcgtcggcgccttaaaagcggtcgcccccgttctggtgctgatgctggtaatggcctcgatcgccaaccaccagcacggccaaaaaaccaatattcgccctattctctttctttacctgctaggcaccttttcaaccgcgctggcggccgttgtgttcagcttcgccttcccttcaacgctgcatctgtccagtagcgcccaggatatcgtgccgccgtccggcattgtagaagtcctgcgcggtctgctgatgagcatggtgtcgaaccccatcgacgcactgctgaacgctaactatatcgggattctggtgtgggccgtcggtctgggatttgccctgcgtcatggcaatgaaaccaccaaaaacctcgtgaacgatatgtctaacgccgtgacctttatggtgaaactggtgatccgtttcgcgccagtcggtatttttggtctggtttcatcaacgcttgcaaccaccggcttctccaccctgtggggctatgcgcacctgctggtcgtcttgattggctgtatgctgctggtcgcgctggtggtcaacccgctgttggtattctggaaaattcgtcgcaacccttatccgctggtgttcgcctgcctgcgtgaaagcggtgtttatgccttctttacccgcagttctgccgccaatattccagtgaatatggcgctgtgcgaaaaactgaatctggacagggatacttactccgtttccattccgctgggtgccactatcaatatggccggcgcggcaattaccattacggttctgacgttggcggcagttcatacgttaggcgtcccggtggatctgcctacagcgctgctgctgagcgtggtggcctcgctgtgtgcttgcggcgcctccggcgtggcaggcggttcattgctgctgatcccgctggcgtgcaacatgtttggcatcccgaacgatatcgcgatgcaggtagtagcggtcggctttattatcggagtattgcaggattcgtgtgaaacggcgctgaactcatctaccgatgttctgttcactgcggcagcctgccaggcagaggacgaacgtctggcgaataacgccttgcgtagctaagtgattatcaatgccggatggcgcgtgccatccggcgtgacgataaatcagaatctcccaatccataggctgtgacggaaagcgaattgatgttcacgcgcgacatcctcgcgtaacgttatatgtagatggcgtctgccgcagcgctcggtcagcgtaaagtataaagtgtcagcctgtgtaaatcctctcgccaccctcctttgcgataagcaaaatcaaagctcaacgacgcgtaatttctataacggacttcgttgacctttgttacaattagatgcattttgaatttttgtgtgttagtgcttgcttacttcacaacttaacaaggaatagttcaggccgcgaatttgccgtttccgcaacgctgataaaaactccaactctgttgcggtagtgcaaacctcagatcaccggcgtgacgttaaccgattctccaggaatactgaatggaactactgactcaattgctgaatgccctgtgggctcaggactttgaaacactggccaatccttccatgattggcatgttatattttgtgttatttatgattttgtttctggaaaatgggctgctccctgccgcctttttgcctggcgacagcctgttgatactggtcggcgtgctgatcgccaaaggcgcgatgggttttccacaaaccattttgctgcttaccgtcgcggccagcctgggttgctgggtcagctatatacagggtcgctggctggggaatacccgcaccgtgcagaattggctctctcatctccccgcacattatcatcaacgcgcccatcaccttttccataaacacggcctgtcggcattattgataggccgttttatcgcgtttgtcagaacgctgctacccaccattgccggcatatccggcctgaataacgcgcgctttcagtttttcaactggatgagtggcttgttgtgggtgcttatcctgacgtcgctgggctatctgctgggcaaaacgcccgtctttatgaagtatgaagatcagctaatgtcatgcctgatgctgctgcccgtggtgctgctcttttttggcctggcgggttcactggtcatgctgtggaaaaagaagtatgggagccggggataacttatgcttaaaccacgcataactgcccgacaactcatttggatcagcgcttttctgctgatgctgaccatactcatgatgacgtggtcaacgctgcgtcagcaagagtcgacgctggccattcgcgcggttaatcagggcgccagtatgccagacggcttctcagttctgcatcatctggatgcgaacggcattcattttaaaagcattacgcctaaaaatgacatgttgctcattaccttcgattcccctgcgcaaagcgccgcagcaaaaacagtgcttgatcaaacgttaccacacggttatgtcgtcgctcagcaggacgatgacaacgaaacggtacagtggttgtcccgcttacgggaaagctcacaccgctttggctaatctccaggaatccgaatcatatcactcactttggtgatttcattgtttaatgactatgattaataaagcggtgcttaacccaccgcgttattatcgggatcaccgccccggacaacgggtccgaacataagggaaagttcaggaatgaaataccgcatcgctttggctatcacgctttttacgcttagcgccggcagctacgctaattcgctttgtcaggaaaaagagcaggatatacaaaaggaaattagctacgctgaaaagcacaacaatcagcgccgtattgagggtctgaacaaggcgctcagcgaagtacgcgccaattgtactgacagcaagctgcgcgccgagcatcagaaaaagatcgctgagcaaaaagaagaggtagccgaacgccaacgtgatttagccgaggcaaaagcaaaaggcgatgcggataaaatagacaaacgtgaacgtaagctggccgaggctcaggatgagctaaaaaaacttgaggccagagactactaaattaacgccgaatgtaaatactcactcacctggagaaaactatgtcgaaagataacactacggaacatctgcgcgctgagttgaaatccctgaccgatacgctcgaagaagtgctgagctcttcgggcgaaaagtcgaaagaagagttgagtaagattcgtagcaaagccgagcgcgcgctgaaagagagccgttaccgcctgggcgaaacgggtgatgtgattgccaaacagactcgcgtcgccgccgcccgtgccgatgattatgtgcgcgaaaacccctggacaggcgtaggcattggcgccgctgtcggtctggtgttgggcgtactgctgacgcgtcgttaattatggcggactctcgacaggcacaaggaccaggcaaaagcgtactgggtatcgggcagcggattgtcaccattatcgttgagatggtggaaacccggctgcgactggcggtagtagaactggaagaagagaaagcgaacctctttcagcttttgctgatggtaggtcttaccatgctcttcgcggcgtttggcttaatgagcctgatgattctggtcatctgggctatcgatcctcagtaccgtttgaacgcgatgatcgctaccacagttgtactgttagtgcttgcgctaatcggcggcatctggactttgcgcaaagcgcgtcagtccacgctattgcgccatacgcggcacgaactggctaacgatcggcaaattctggaggacgatcagtcgtgagcagcaaaggcgaacgcgaaaaacgtaaagcgctgcttctcagtcagatccagcagcaacggctggatctgtccgccagccgtcgcgactggctggagaccaccggcgcgtacgatcgcggctggaatacggtgttaagcctgcgctcctgggcgctggtcggtagcagcgtaatggccatctggaccatccgtcatcctaatatgttggtacgctgggcgaaacgcggcctgggtatctggagcgcctggcgcctggtaaaaactaccctccgtcaacaacagctccgcggttaatatcttttcttttatagcatcgcgccatcaggttatcacccgattacacctggtggcgcgatacttttatgcatatcgtctctttatcaatcactcaaattttttgaaaaaatttggcaattttccttgctaacaattcctgtacgccacgtttatgattctctccagcgataacaatgacgcgctaaaccgcgccattgctcatgaaaatagcagcagccgccgaatcggcctcctggagaataaaatgaaaaaattagaagatattgatgtactgatagcgcgtattttaatgccagttctgtttattaccgcaggatggggaaaaattagcggctatgcgggcacacagcagtatatggaagcgatgggcgtaccaggattcctgctgccgctcaccatactgcttgagttcggcggcggtctggcgattctgctggggttcctcacccgcaccactgcgcttttcaccgctggttttacgttgctgacggcattgatcttccatagcaattttgcagaaggtgtaaactcgctgatgtttatgaaaaacctgaccattgccggaggattcttattactggcgttaaccgggcctggcgcgttcagccttgaccgtctgctgaataaaaagtggtaagcaatctatactcaattaaaaaagcgagggaatagcgcctcgcttttgttatctgaaggagagagacatgggacaactgatcgatggcgtctggcacgatacctggtatgacaccaaatcttccggggggaaatttcagcgttcagcgtcggctttccgcaactggcttaccgctgacggcgcgcccggaccttccggcgaaggcggattcgccgcagaaaaagatcgttaccatctgtacgtttcccttgcctgcccctgggcgcatcgcacgctcattttccgtaaactgaaaggtctggagccgtttattccggtttctgtcgtgaatccattgatgctggaaaacggctggacgtttgatgatacttttccggcggccaccggcgataccctctatcagcatgaatttctctaccagttgtatctgcacgccgatccacactacagcggccgcgtcaccgtgccggtcttatgggataaaaaaaatcatactatcgtcagcaacgagtccgccgaaatcattcgtatgtttaactccgctttcgatgggctgggcgctaaagccggggattactatccccccgcgctgcaaagcaaaattgacgagttaaacggctggatttatgacaacgttaataacggcgtttataaagcaggcttcgccactagccagcaagcgtatgatgaagcggtagaaaaggtgtttactgcgctggcgcgcctggaacagattctcggacagcaccgctatctgacgggcaaccagttgaccgaggcggatatccgcttatggacgaccctggtacgctttgatccggtttacgtgactcatttcaaatgcgacaaataccgaatcagcgactacctgaatctgtacggtttcctgcgcgatatctatcaaataccgggcattgctgaaaccgtcaatatggaccatattcgtcaccactatttccgtagccataaaacgattaaccccacgggtatcatttctgtcggaccgtggcaggatctgctcgaacctcacgggcacgacgtgcgctttggctaatttcaggcgtcctccgggacgccttattaataaatgccacaaatatttaccagcatttcattcgcagctattcttagtttgattactttaaaaacaagtgattgaaccattattgaggcgaaaatggattggtatttaaaggttttaaaaaattatctgggatttggcggccgcgcgcgacgcaaagagtactggatgtttattctggtcaatatcatctttacctttgtgttgggcctgctggacgccatgcttggctggcaacgcgccgggggtgaaggcgttctgaccaccatttacggcgttctgatctttttaccgtggtgggccgtgcagttccgtcgtctgcatgacactgaccgctccgcatggtggctactgttgctacttatccccattatcggctggcttatcatcatcgcgttcaactgccagaatggtacaccgggcgacaaccgcttcggccccgatccgaaacgtttttcctgagggcggcgcggcgccgcttttaaagcgccgcgcgctatttattttccggcgaatagcttaggtatttcccgcaggcaccaggcttttgcctcccccatactgtcgcgccgccaggccataataatatcgatttcgctggtcgattccgggctgactacgcgtagccgcccttcggcaatatcctgttccaccatcgaatatggcatcgtcgcgacgccaagcccggccagcagcgcctgacgtttatcttcaatcgtgcttaccgtcagacgtggctgcttatccagcagttgcaccgttaataccggccgctcgcgcgcggtatccgctaccgctacgccgcggtatttaacccgcgtcacttccgaaagcggctccggctcctgatgaatagagtggtcaggcgcggcgacatacacattcattaacgtatacaacttacgggagttaatttccgacgacgatcgaaaatgcatatccggggcgataacgatatccgcccgtccctgctcaagccgctcccatgcgccagccagtacttcggtaatcaatgaaagctgcgtattggctttagcggccagccggtcgatcagcggaaaaaaagcaggcgtcggtaccagagcttcagtgaccagcgtcagatgcgtttcccaaccgcgggccaacgcttcagcatccgtcgttaacttgtctgccgcttccagcaatacccgcccgcgttccagcagcatacgtccgacgttggtgaattttgtacgatggccggagcgatcgaacagtacaacgtccaactcttcttccagcttctgcatggtgtaactcagcgcggagggcacccgccccaactcatcagccgctgcggcaaaactgccccggcggtcaatggcgtccatcacacgcaatgcttcaagcgtcagcgctctctctttagccataacgttctcattcaggaaatttgaacataccgggcagaatatctggctaacaatgcagcgtccagccccttaacataaaaggaagtaaagagaggttaataacgatgattacgacccgaaccgccaaacaatgtggacaggcagactacggatggctacaggcccgctataccttctcctttggacactacttcgaccctacactgctgggctacgcgtcgttgcgcgtactgaaccaggaagtgctggcgccgggcgcctcttttcagcctcgaacttatccaaaggtggatattttaaacctgattctggacggcgaagcggaataccgcgacagcgacggcaaccatgtacaggctaaagcgggcgaagcgttgctgctcgccgcgcagccgggcattagctacagcgaacataatctcagcaaagttaagccgttaacccgaatgcaactgtggcttgacgcctgtcctgaacgggaaaacgcgctggtacaaaaaatcccactctcgacggcgcaacaacagcttcttgcctcgcccgacggtgagcaaaacagcttacaactgcgccaacaggtctgggtacatcatattacgctggagaaaggcgaatcgcttaacttccagcttcacgggccgcgcgcctatttgcagtcgattcacggtacgttccacgcgatgacgcacaacgaagaacgcgaggcgttaacctgcggagatggcgcatttattcgtgatgaacctaacattacgctggttgccgatacgccgctgcgcgcattactggtagatttaccggtgtagccagccagaaaaggagtcgcaagatgagcaaaaaatcggcgaagaaacgtcagcccgtggtaaaacctgccgtacaggaggcgatgagcgccgctgtgccgctgggctatgaagagatgctaaccgaactggaagccatcgtggcggacgccgaagcccggctggcagaagaagaggccgcagcctgaaatcatgccggatggcggcgcaagcgcccgatccggctgataacgggtagacccgataagcgcagcgccatcgggcaacacgctgccccgacgtcatgccggggcgttattattaatgcgctttactggccataatctcgatgatctgcttgtctgtctgctgcattgagcgacacgccagcgaacacaaattcgaaatagattgttcgacattgtgcgccacaatcccttcgtttccggtcaccgccgtatcatccaacgccatcagtacggctttccacgccgccgacgcgctggtagagactttcatcgcgcagctattcgacgcgccatcgcaaatcatcccgctgacatcaccaatcatactgctgatagccattgcgatagtgtcgtaacgaccatctatcagccacgccatacccgctgccgcgcccattgccgccgtagttgccgcgcacagcgccgacaaacgcggaagctgatggtgaatatagatagcgctcaaatgcgataacattagcgcgcgcgccaggcactcgtcatcggcgccgacatgttcagcaaccaccatgactggcaccgtggcggtaatcccctggttgccggagccggagttgctcatcgcgggcaacgtggcaccgcccattctggcgtctgacgccgcgctggtacggatcaaaatcgccgtggagagatctttcgccagcagaccgcgatcgcactgtttggccagcgtcgaaccaatatgcagcccccaggaaccacgcaagccctcctgcgacaacgcgccgtttagcctggccgcatcgagaataaagcggatagcgtcaaagggcaccgcattcacaaacgccaggatctcttccagcgaggtatgagacagcactcccagtggcgaggttttttcttcttcctgcgcattatcggcttgggtaaataccacgcccttgtcggtttctatccgcacaatatttgtatgatcgccgacgatcgtgacacatgcccagctatcgccgctatacactttcgcccgtgaaaacaggatatcgttacatggctcctgcaacatcactgcaacatgtccggcggccagcatcgcttttgcatcggcaacggctttagcggaagcgtcttttaacacctccaacccggctttcgcatcaccgcccaacgcgccaagcgccgcggcgatcggtagccctaccattcccgttcctggaacggtaacgcccataccatttttcatcagattaggcgaaacccacgcgtcaatgcgttcaactgtgccgtcaagttcagccgccgccgccgctgctgccagcgccagtgaaattggctcagtacaccccagcgccggttttacttcttcctgtacggccaggataaaactttgccacaatggatttattttagattcaaacataacaacaaccttaatctcaggtatatcaagagaatgccaggaacggagaaacgcatagcagcagaccggtaataataatcaggtacaacgaagcgcctttatatttgtgcaatgcgggaaccttgtagaccaaccatgccggaattaaacagcccaccataccgaagatagggctacaaatagaggtgaagctcagtaccggcgcgttgagcacaatggcgctccaggccagcaaaatagcgaaaatcataatgccgcgctgtaccagattttccttaatcttctcggcgggcattttgcggcgcaggatattcatcacaatgccttgcgtcgcttcgcggaatcctaaataaacgccaaagaaggcggtcatgacggcaaagatgttcagaattacgctaaccactttgacccagctagcgccatcgccgctaataaattgcgcggcgatcgccagggcggaaatattctgctcgtaggctttcaccgcttcgtcatgccccatcgccagggtgaaggaaaccgcatagaaaaagacggtaacgaacaggatgccaaacgcgatattcatggcgcgcagcgcttatggcgtgcgacctcaatagatttttcgcgtgaacggtaagagatcaccattgggcttaacgtctggataaataaaatcgaggtcagcgtaaatggcagggtaataatggcgtttttaatcagcagggccatcggcggcagcgcgccaatgttatacagatgccacatacccaccatagagacgcccagcgccgccactaccagtagcttggtcagcaccatgccggtggaaattttgaacagtaatttttcaccgcgtgaggaaatcgccaccaggatgcagatcagcaccagaccataaaatggactatcggaaagtaatccttccgttacgccgaaagtatgcagataagaggcgctgtcgttagtaatcgccgtagaatagacgaacatccagatgacgagcatcacaaagtacagcgcgcctaataaaataccccagtttttgcccagatagccgctgatcacgctggggtagtctttacattccggggattccgccagcgtattaataaacagccgctggaacaggtacatggccggataaccaataatagaagagagtaaaaagacccaaagtcccatcaggccaacctagacaggaagaaaaacgatccctgcgccgatcgccatcccgatactcataatgacccagccggtgtcggtactatcaaatttgatggcttcacgccattcgctttctgtcatccctgcccgacgcgccggggctgatgcgtcgaggattacgctggtattactagccgattccataaaattctcgctcaatgtgtaggtagaggtttttttatttttcgtgccgcagcaaggcgatatgcagaacgtgaggtgcaggtactttcttgtaataagaaaatcatacgcgcacgataagagaaaaacttaccaataaaacgcctgcatttcttgtgggttaagaattattttctatttactatttatttaatattgttattttctctatttgacgcgtatcacaacaaaaaagggcgcactttggtgcgcccttttctcagcttctgtcttctgcgttatcccatagcctgctcactctgcgcctgtcgggcctatccacaaacgactttaatcgccagaccgccgcgcgacgtctcgcgatatttgtcgttcatgtctttacccgtttcgtacatggtttcgatcactttatcgagcgaaacccgcggctcagaggtacggcgtagcgccattcgcgccgcatttaccgctttaacggcgttaatcgcattacgttcaatacaagggatttgcacctgacccgccaccgggtcacaggtgaggccaaggttatgctccatcgcaatttccgccgcaatacagacctgcgccgggctgccgcccagcagttctgtcagccccgccgccgccatcgaacacgcgacgccaacctcgccctgacaccccacttccgcgccggatatcgaggcgttcatcttgtacagcatgccaattgcccccgccgacagcagataacgggcgatagagttggcattgaccggacgacggaatttgtcgtaataggccagcaccgcgggaataatgccgcacgcgccgttggtcagcgcggtgaccactcgcccgcccgccgcgttctcttcgctcacggccagggcgaacatgttaatccagtcgatgacgttcatcggatcgcgggagagattatcgctggagaccagcagacgccgtaacgctaccgcgcggcgtgggacgttcagcggccccggcagcacgccctcagtattcatgccacgttcaattccggtcgccatcacctgccaaatgcgggcaaagccagcgtcaatctgctctttgctccgcaacgccagttcattttgcatcatcaggccggaaaccgagagcccctgcctttcacacagcgtcagcagttcgctggcggaatgaaaatcatacggcaccgatttttctacgtcgtgcgactgaccaaaacgttcctcttcgacaataaagccgccgccaatagagtaatacgttttgtgtaaaagcggcgtttgcccgtgccaggcggtaattcgcataccgttttcatggcgcgccagggtttcagcgtgaaagagaatactgtcggcgacgggaaaatccaccacatgcgcgccacccgccaccgataaacggctgctgcgggcaacctcctggataaacgccggaatgctatcaatattgacatcctgcggcgtattgcccgcaagacccataatgatggcggtatcggtcgcgtggcctttgcccgtcagcgatagcgatccgtaaagatcaaccgtgatgcgcgtcgttcgcggcaggtcgccgctgtcgatcagccgatcgataaaacattttcctgcattcattggccctacggtatgggagcttgaaggtccaatgccaatcttaaaaatatcaaatgcgctaatcatatctccccctaagattaccgttcagtgaagatccgtcgcggggcgatccacacgatcgccccgttcacgttacatcgcctgagtaaaggtgcgcgaaataacgtcctgttgctgctcacgagtcagcgcattgaagcgcacggcatagccggaaacgcggatcgtcaggttcgggtagttttccggatgttcaatcgcatccagcaacatttcacggttcatgacattgacgttcagatgctgcccgccttctacctgtgcttcatgatggaaatagccgtccagcaggccgacaagattggttttccgcaccgcatcttctttcccgagcgccgcaggcacaatcgagaaggtgtacgaaataccgtctttggcgtaggtaaacggcagtttcgccaccgacgtcagcgaggccaccgcccctttgcggtcacgaccgtgcatcgggttcgcccccggcgcgaacggcgttccggcgcggcgtccatccggcgtattgccggtcttctgcccgtacacgacgttcgaggtgatggtcaaaatggactgcgtcggcaccgcattgcgatacgtcggcaacacgctaattttttgcataaagcgtttcaccaggtcgcaggcgatgctgtccacgcgctcatcgttgttgccgtactgcggatactcgccttcaatagcaaagtcgatggcaaggccattttcgtcgcgaatcggcttcacctgagcgtacctgatggcggatagggaatccgccgccaccgacagtccggcgatgccgcacgccatcgtccgatacacatcacggtcgtgcagcgccatcagcgaagcttcatagctgtacttatcgtgcatatagtgaatgatgttcagcgcgctaatgtactgcaccgccagccagtccataaaatggtcgaggctctccattactgcgtcataatccagcacctcatccgttaacggcgcggttttcggcccaacctggattttcagtttctcgtcaacgccgccattgatagcgtacagcaacgttttggcaaggttggcgcgcgcgccgaagaactgcatctgcttaccgatgaccatcgggctgacgcaacaagcgatggcgtaatcgtcgctgttaaagtcggtacgcattaaatcgtcgttttcatactgcaaagatgaggtcacgatggagacctgcgcagcatatttcttgaatgccaccggcaacgcttctgaccacagtatggtcaggttcggctccggcgctggccccatcgtgtgcagggtatgcagataacggaaagagttcttcgtcaccagcgtgcggccatcaagccccatcccgccaataacttcggtggcccagatcggatcgccggaaaagagcgaatcaaattccggcgtgcgcaggaagcgcaccatgcggatcttcatgatgaaatggtcgatcagctcctgcgcctgctgctctgtcagaagacccgcgttgaaatcgcgctcaatgtagatatcaaggaacgaggcggttcttcccagcgacattgcaccgccattttgcgattttaccgccgccagataagcgaagtagagccactgtaccgcttcctgcgcgttccgcgccgggcgggagatatcatagccgtatttcgccgccatctcctgcatttgcagcagcgcgcgacggtgctccgccaactcctcacgcaggcgaatcgtcgcctcaagattctgtccccgctccagattcgactgcaggtcggcgaattgcagctcgcgttcgcgcaccagataacggatgccatacagcgcgacgcggcgataatcgccaataatgcgcccgcgaccataaccatccggcaaaccggttaatacgctggatttacggcagcgcagcatatccggcgagtaaacatcgaatacgccctgattatgggttttccgcaggtcggtaaaggtatattcaaaatcggcgtccatttcccggccataagcgtggaatgaacttttgatcatgttaacgccgccaaacggatgcaaagcgcgtttaagcggcttatccgtttgtaaaccgacgattttttccagctctttttcaatataccccgcatcgtgcgcggtaatcgtcgtcgcgatgttggtatcgaaatccaccggcgcatgggtcgcgttctcgatacgtattcccgccatcaccttttcccacaacgctgtggtcgctggcgtcgcgtcggcgagaaaagattcatccccctcatagggcgtatagttatgctgaataaaatcacagacattaatttcttctttccagtccgtacctttaaaatcacgccatgcttcggcatacagcatatcgctggtatcgatatttaccttcatgaaaaataatctctctacagaacagccgttaagttatgcaaattccactggtgctttcacgttgcctaaatgaatggcatcaagggcaatcattttctcttcattcgtgggaataacagcgcaaataacctgagaagggttaacggaaataatgcgctcgccgtgagaattcggctgcttattcatttcaacgtctaacgtaagccccagtacgcccaaatgttcaatgaccaactggcgaattaatactgaattttcaccaataccgccggtaaaaataatgccatccagccgatgtaacgatgccgcgtgtccggcaatgtgacgggcgatacggtggacaaacgtttttatcgctaaccgggcgcgctcatgtccttcgtgccaggctttttccaggactctaaggtcggatgacaacccggagatgccgagcaaaccggactctttattcaccactcgctccagatcgctcaacgtctgcccggtttctttggctatccacgccatcgcgccgaaatcaacgtcgccgctgcgagtgcccatcatcagcccctcaagcggcgtcatccccattgaggtgtccacgctctgaccattgcgtaccgcgcagatagacgccccattgcccagatgcgcgacaatcagacccgagtttttttcatcgaggtcaagcagttcatacgcgcgccgcgaaacatagcgatgcgacgtaccgtgaaagccgtagcgacgcacacccaggctggaaaaatattcccacggcaatccgtataaataggcttccggcgccagcgtctggtggaaactggtatcaaataccgccacctgacgcacggccgggaaaaggcgccgcgccgcgtcaatgccgcttaaattagcgtaattatgcagcggcgctaaaggtgatacccgacgaatattatcgataatctcatcggtaataatgacggactgcgtaaatagctctccatcgtgcgcgatacggtgaccaattaatgccacgctatccgttaaatcacgtttttccagctcaaaggcaatggcttttaacgcgtcctcataattagagtgcgagaggtttatcggcttatcgccattaatagataaaaaggcgttttcagtattcattccatctgctattcccgccattaaaacatcacaggtagcgacatccagtacagagaatttgatagaagatgatccgcaattaatgaccagaacgaccggaaattcattcatgtagtgcctccgtcgatgtcagcctgcgtccacgccctggggcggaacgcaggctaaacgtgaggattagaacaatttgtagacaatattcaggatggtcagcagaccaatcagggtgacgaacacgttatccagacgaccacggtacttcgccagcgacggcgctttacgaatggcgtacatcggcagcaggcataacagtgaggcgataatcggcgcgcccatcgcttcaatcaggtccagaatgttcgggtttgcgtaagctacgacccaggtagatcccataatgaagatcatgctgatggtattaagcttgcccatagagactttggttttatcgcctttataaccgaatttcagcaccaggccgttcagcccttccagcgtccccaggtagtggccgaagaaagatttgaaaatagcaaccagcgcgatgatagacgcgccatactccagcaccgttgcaaaagtggattttgtccccgacaaagaggcgaaatggttggccaggtaggaaagtaccggaatgttctgcgctttcgcatccgccatgttctgcggggagagcgtaaacagacagctaaaggcgaagaacatcaccacggcgaccatcagcatatggcgcgcgagatgatctgtgaacatttacgctcggtaaattcgcggccaaactctttctcatactcttcacgcttagacaccacgaaggaagagacgatgggcgaaaagttaaaggagaacaccataatagagatgcccagccacaccgtaaccagtatgccatcgtgcccggtcagcgcgatattactgagatcaacctgatcgataaccgccgagttccagtaaggaatcagcgataatgagattagcaccagactggcgataaacggccataccaggtaactcatcaccttaaccatcagatctttaccaaaccagatcacaaaggccatcagcagcagcaagaacagcgccacgaaaccgcgattcaacgctggtatctgcaactggttttcccaaaacgtcatgaacgtgttagtaatggtgacgccataaatccacagcagcggacaaatcgcaaagaagtaaaggaacgtgataactaccccgcccgttttaccaaagtgctcttcgaccgtttccgtaatattgccggacggattagacccggataaacacagacgcgccagcgcccggtgacaatagaacgcaatgggataagctaaaaccagcatcagcagaatggggataagcccgccaaacccggcgcggatagggaagaacagcaccccggcgccgatggcggtaccaaataaacccagcgtccacgtcgtgtccgatttacgccatgacgactgttttgcctggctggatacaatgctatcagtagtactcatatcctatcctcacgaaaagattaagcgtcaactaaacccgtaatttgtgatacacgagaaagatcgatattgccgccagaaataatactgaccgtttttctgttctgaatatggctatctaatttcccgcttaatagtgcggcgcaggccagtgcgccagcgccttcagtaataaccttattgcgctgaattaaagcgatcatgctgttacgaatttcatcttcgctaaccagaacaatgtcatcgactaattcacgaacaatttcataggttaaattacccgggcgggagacatcacaaccatccgccagggtgccggtcgttcggtgcgcggttatttcgccagcgtaataagacgccgccataccgtgaacattttcggcctgtacgccgataactttaatggtcgggttaatcgatttaatcgcaatggcaatacctgcaattaaaccgccgccgccaataggcacgatgacattatcgacatcgtacagatcttccataatttccagaccaatagtaccctgcccggcaatgacttttggatcgtcgtaaggcggaataaaaatgcggccttcggtttcgacaatttcactcaccttagcaatggtgtcattgaagttgtcaccgtggagcaccacttccgccgaataatcacaggtggccgccacttttgactttggcgcgcccttcggcatcacgactttgccgtcaatacccagcattgcgcaagaaagagaaacgccctgtgcatgattacctgtggaacaggccacgacgcctttacgtttttccgcctccgttaacgagctaagtttgttaaaagcgccacgaattttaaatgaacccgtacgctgcatattttcaaacttgagaaatatttcgcctttgcaacgttcactaaaatagttagagcgaggcattcccgttttatatatcttccccgccagtctttttttcgcttcgaggatatcttcaattgcaaccgggagatcgtatgtaatgtgcattataacctcttaacctgggtattaaaaataagttaccgttgcccactgttcaaaagaaacaggtggcgtcaatttcgctaaatatgtttattccatatcattcaatttctattaactgcctgcgtctgcatccattatatgatgaatattgcttagccaattctactaatactgaagcggcttttttgatacgataatttttagaccataccgccgcataacgtgcgacgggtaatgtgtctttgattggtatcgtgataaattgattagagccaaaaggcgtggtcatatcgcagggaataacagttaagaaatcagcattgagaacaagattatatattgtgacaacggaatctgttttaacaatgttttcgatgctgatgccatttcgttgtagagtggtgagtaattcgctgtagtagcccatattcgtttgcggcaacgcccactgttcgtcctttaacgattccagtgtgatggtgccggtgcatgttcgggacttgctggctaccaggacaaactctgattcaaacagcggctcgacatgcagatcctgtagctgcatttcattactgagcgtaccgatagcaaagtccagccgcccgtcgcgcagggccggcaggaatgaagagagctgggcttcgtacatggatacctgcgcttttggaaatacctctttgaacttatgaatcatatcggacatgaaggtaaagccaatcagcgaaggaaaaccaaacgagacgtcgacaacggtattgcacgtcatactgttcatctcgttgatcatgtttttcatttcgcgggtgatagattcagaccaggaaagcagtacctgtcccgcttcggtcaacgtaacgccggtatttttgcgtacaattagctcaacgccaaaataggcctcaacatcgctaatgattttactgacggcgggttgggttaaccctaacgattttgcggcagaaccgatagaaccacttctaatgacttcctgaaagaccaccaaatgctgtgttttagggagaacaagagtattcatatctaccgctctgaaataacattgtgaacggcaggaagtgtagcaaattaaatcttaaaggttatgtgcgaccactcacaaattaacttaccgcaatttttacatggtctttattaaataaagaaaacctattacttcaatgagttacaaaaacaagacagtaacttagcctgatttcaatcaaaaaaaatggtcgggataacgatatattatggcgataaccagcctattttatctcctattttcgacatcccatgaagacgatatttcaatcaattacgggacattttatcgacaattccagcgttaaatttaaaacgtaatttctcaaatttaagtataaaccgaaggtaaatgcgcttaaaaaccgttacgcgtcacatttttttaccttatttgtttgtaaagaaacatttaataaaattttaaccaaaatatttcatacatttaattttcatttgcaacaaataatttacaccgttttcttgctgtttttcaggatgtaattttgtgaaagaaatcgattgcttttcacttcaactaaaaagagcgcaatccatagcgttttgtgtttctcatcacaaaaacgaataatattatgtcaccacggctgtcaattaattgccggatggtgacactggcgtcttctgcaacctctatacccttcaccggcctgataagcaaaaacccgccgaagcggattttatgaagaggtgaaactgaccgataagccgctttctttcgggtatagcgtcgtggacagtcattcatcctgccgccctgtaaaagcaaaaacccgccagcttacactgacggggtttatgaagaggtgaaactgaccgataagccgctttcttttgggtatagtgttgtggacagtcattcatcctgtcgccctgtaaaagcaaaaacccgccgaagcgggttttatgaagaagtgaaactgaccgataagccgctttcttttgggtatagcgtcgtggacagtcattcatcctgccgccctgtaaaagcaaaaacccgccgaagcgggttttatgaagaagtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccacttgcgtgggccatcggcggtttgctctctgttgcactggtcgtgggtttccccccccaggcgttacctggcaccctgccctatggagcccggactttcctcccctccgcccgtctccccgaaaggacgacgacgaagcggcgactgtctggtcagcttcggcgcgcagtatagagggttcgcgcgactttgtcaccctgcgctgcgcattcctatcgccagagcggcagcaacatttctggatgcccgataaatattgtcaaaagcgccccgaaaagcctcctccagcgtcacgatgcgcgtgagtacgctaaagacagcgtcgatgccataatgatgtactattcctacatcgtgcgtcaggctgccggcaatgccaatcactggcttatgatattttttcgccacattcgcgacgccaatcggcactttaccgcgaatgctttggctatcaatccgcccttctcccgtcaccaccagcgtacagtcgtggatatgctcctccaggttcagtgccgccgtgacaatttcgatcccgctgcgtaattccgcaccgagaaaagccattaacgccgcccccataccgcctgccgcgcctgcgccgggcgccgcctttacgtcgacattcagcgatttttttatgatgtcggcataatgagcaagattcctgtccagctcaacaatgttctcttcggtcgcgcctttctgcggcccaaaaattcgtgatgcgccattgtcgccgataagaggattggagacatcgcaagcgacacgaatagcgcagagttttaaacggggatcgagctctgaaatatcaatgttgcttagacaatgaaggcttccgccaccgtaaccaatatccgcgccgtttgcatcgcgcagttttgcgcctaacgcctgcatcatccctgcgccgccgtcatttgtcgcgctgccgccaatgcctataatgatattgcttgcgccgctttccagcgcctgcaatatcagctcccccgttccccgcgaggtagtaatcaaagggttgcgtttttctggcggaaccagcgccagtccgctggccgccgccatttcaataaacgcggttttaccatccccggacattccccagcaggctttcactttttcacccaacggcccggtcacccatgcggcgcgttcaacgccctgcgtcgcggcaatcatggcttcgaccgttccttcgccgccatcggcaaccggaacagagacatattgcgcatcggggaaaatttcccgaaatcctttttctatcgcctgcgctacctcggcggcagaaaggctttctttataggagtcgggggcaattacgattttcatagtggtagcctgttactgcacaacgccggatggcgtttcacttatccagcctgaaattcaggcccggatcgctacacgccatccgggcacaacgtcgttagcgagtgacttccactttcgccagtttttcgtagtagcacgccagcgcgctatggtcgtcattaccgtgtccatccgcgcgtaacgcctgcatcatttccataacggcggcggtcagcgggagctgcgcgccaacgccgtgggaggtatccagcgcattcgccagatctttaatgtgcagatcgatacggaaacctggcttaaagtttctgtccatgaccatcggcgctttcgcatccagtaccgtgctgccagccagaccgccacgaatcgcctgatagaccaaatccgggttgacgcccgctttagtcgccagcgtcagcgcttcagacatggcggcgatattcaacgccacgatcacctggttagccagttttgtgacgttgcctgcgccgatatcgccggtatgcaccacggaacccgccatcgctttcatcaggtcgtagtacttgtcgaaaatggctttatcgccccccaccatcaccgacagcgtgccatcaatcgccttcggctcgccgccgctgaccggcgcatccaacatctcaacgcccttcgccttcagcgcatcgctgatttcacggcttgccagcggcgcgatagaactcatatcaatcaatacggttcccggcttcgcgccttcgatgataccgttctcgcccagcgcaacctctttcacatgcggagagttaggcagcatcgtgatgatggcgtcacactgttcagcgatcgccttcgccgtagaggccgtttccgcgcctgcggcaatgacgtcggcaatcgcttcaggattacgatcggacaccaccagcgaataccctgctttcagtaagtttttgctcatgggcttacccatgatgcctaagccaataaagccaactttcatcgtcatagcgttctctctttccataccaggattattttttaaaggtgtcggcaagcttctgcgtgctggcgcggaatgcgcctaaatcgctgccaacggcgacaaaggtcgcgccccattccagataacggcgggcatccgcctctaccggcgccagaatgccgcacggtttaccgtgcgctttagcgcgggcgaaaatatgttgaatcgtctgctgcacgtcagggtgagaagcattgccgagatgacccagcgcggcggccaaatcgctagggccgacaaaaatgccatcaacgccttccgttgcggcgatggcatcaacattgtcgacacccaactggctttcgatttgaacaataatggtgatgtttttgttcgactgcgcaaagtaatcaggcaccgtgccgaacatattcgcgcggtgagaaacggagacgccgcgaatgccttccggcgggtaacgcgtcgaggcgacggcgcgagccgcttcctcttgcgtttcaacaaaggggatcaggaagttataaaacccaatatccagcatccgtttgataatgaccggttcattggttggcacacgtaccacaggcgcgctggcgctgcctttcaatgccattaactgcggaattaaggtggtcacatcgttcggcgcatgttcgccatccagcaccagccagtcaaatcccgccagaccgagtacttcggtggtgattgggcttgccagtgcagaccagcagccaatctgcacctgttgcgccgccagcgccgctttaaacttattcgggaaaatagcgttattcatcgcttataccttcgcttatttctttaattctctacatgtgatgccgccaccatgacttatagcaacgacaataaaaatgcttatttgaaatcagaatgggtctccacattctatttctaatgtggtacacatcctgtagcacaatataccgttctgatatctttatcgtcttttattattatcatgatattttcaaataactcgtcagatacactgaattcgccattcagtataaacagcctatgtcggataatcattgtgcaaacgctcattaaaaagggtttatttaacgcttatttttgagcatacgcccatgatactgggcgctaatgcacacatttacgctttgcctgccctacataaaaaatttcataatttgcggtgatctggatcacgttcttatatctatactcctgtcattcttatttcattatgcatgaactttatttcttatattgagatttaacgatttaaccataaccaaaatagataatcctatttctatcatccaggctggagaatgttgaacaatggccaatatcgaaattcgccaggaatcgccatcggcgttttatataaaagtacatgaaaccgataatgtcgcaattattgttaatgaccacggccttaaagccggaacacgttttccggatggcctggaactgactgaacatattccgcaaggccataaagtcgctctgacggatatccccgctcacggcgaaatcatccgttatggcgaagtcatcggttatgcggtacgcgacatcccgcgcggaagctggatcgacgagtcgctggttgaactgccaaaagcgccgccgctgaatacgctaccgctggcgaccaaagtaccggaaccgctgccgccgctggaaggctacacgtttgagggctatcgtaacgccgatggcagcgtcggcaccaaaaatctgcttggcattaccaccagcgtgcactgtgtggcgggcgtggtcgattatgtggtgaaagtgattgagcgcgatctcctgcccaaatacccgaatgtcgatggcgttgtagggctaaaccatctgtacggctgcggcgtggcaatcaacgcgccggcggcggtcgtgccgattcgcacaattcataatatcgcgctcaaccccaattttggcggcgaagtgatggtgattggcctcggttgcgaaaaactgcagccggaacgactgctggaaggcaccgaggatgtccccgccatcgccgttgaaaacgccagtattgtgcgtttacaggacgagcagcatgttggctttaaatcaatggtcgacgatattttgcgggtcgccgaacgccatctgacgaaactgaaccagcgccagcgcgaaacctgcccggcctccgagctggtcgtcgggatgcaatgcggcggcagcgatgcgttttctggcgtcacggcaaacccggcggtgggttatgcttccgatctgctggtacgctgcggcgcgaccgtcatgttctcggaggtcaccgaagtgcgcgatgccattcatcttctgacgccgcgcgccatcaacgaagccgtgggtaaacgcctactggatgaaatggcctggtacgataactaccttgatatggggaaaaccgatcgcagcgctaacccgtcccccggcaacaaaaaaggcggcctggcgaacgtcgtggaaaaagcgctgggctctatcgctaaatcgggtaagagcgccattgtcgaagtattgtcgccgggccagcgccccaccaaacgcggcctgatttacgccgcgacgcccgccagcgatttcgtctgcggcacgcagcaggtcgcttccggcattaccgtacaggtctttaccaccggacgcggcacgccgtacgggctgatggcggtgccggtcattaaaatggcgacgcgtaccgagctggcgaaccgctggtatgacttaatggatatcaatgcaggcaccatcgccacgggtgaagagacaatcgaagatgtgggctggaagctatttcactttattctcgatgtcgccagcggccggaaaaagactttctcagatcaatggggattgcataaccagctggcagtgtttaaccccgcacctgtgacctgatctattctggaaagcgcctcgcaaaacatggcttaagggccatgttttcatatgtttgataaactgcgccatgttcataccggatatggcaaaaacacctaacccaccataaaaccattcaaattcaataaattgaaattctatgccaggcgcaaccttacgtttctcactaatttgagtcgcagcacatgcaatttgaggtatgtcgaatataacgacagcctattaatcacctttacttaattctgctgcctcatcaattctttaatttgtgccagcgtggacgtgccttccatcggcccacgcgcagagatagccagcgatcctgcggcattagcatgggctaaagcatcgggtacggaatatcccgcaagaaacaggctgacaaaggttgcgccaaagcaatcgccagcgcctgtaggatcaaccaccttcaccggatacccagccacatgatgttgttcgtcttttgaatagtaactggctccacgggcgccacgtttaatgatgacatgggcaattccacgcttgtgaagccttgcgacaattttctcttcatcgcgggatttgctcaggccgaaataatccagttcgccatcgcttggcaggaagaaatccgtgtaatcaagaatatattcaaaggcctgcgacatttcgcggatctttagcatctctttacggatattaggatcgaaagaaattgtgccaccattttcttttacaatgctaatcgccttgcgtacggcatcgatcaaacgaaaggaaaataatgacgatcccataatatgaaagtggcgatattgcctgagtaatgtttcatcaaggtggtcggcactcagcaaaccgcacgcactgtccggcatgttgaaaataaaatctcgctgggcctggcttcggtagctgacaaaagcactacctgttgtggcgttcggcagtacggaaattccctgtacatttacgccatcgcgcgacaatcgggtaatattcataacgccaaaggcatcgttgccaacacagctaaacaacaatgaacgaaaaccaagtttagcaacctgatcggcaaatatggcaggcgccccactgggatacggcccccaaaattcccccggtgaggaaaatccctggttctctttttttgccagaaactcgacgagcaattcactcaatgttgcgattgttatgttcatgcgttgtccttcatcttgcctgatgcagggtcgggtttatccaggtcagacattcgttattggtatagctgttggttaagccgtcggccagaaaccgtgagtggtactcagcggcgacaatctgtggcgtaataatcgcgctcagcgtattcagttttcctaccggataacgcgctatatcatgaatcggacgctgcgccaccacggcaatactctgtccactaaggcgcaggcattcacttagcaaagcagctgcactttcgtttttcacgttgagcgtgccatcctcgctgatatggtccaccatcaccagacaacatgacggttgaaattgttgcaaagattggatggcgatttcgccccccagcgcctgaccactgcgccccagtacaccgcccaacaacacaatttcaccatcgatataatcacgggccggtgcaacatggctaagatcgttgatgataaggcacagatcccgataatcgcccaggaaaggaagcgctttacgcaacacctctccggcccccagaaacacggtatcgtcgtcgcagaccagacgggcaacttgcttagccagttcaagctcgacgctatgctctaacgcctgcgactgcaccacttcatggcttaccgctgctctgacgggttgggccgtgtaaatcgctccgccaaaggagcgtttcagatagccttgctgctccaggtaattgagatcattacggatcgttacccctgaaaccgataacatttcagccaaatcgtctacttttatttcgccgtttttacggacgatttcggcaatgtccagacgccttttcaacaggctggtagatggttttgccacaacataccctttttttccgcttcgtcgggaagttatcccgtgctttaactttcatttttaaacttctgacaggggatgtcaattttgcaccacgtcaccgaatgctcaatgggaaacatcacaataaaatcaatcacttatagaattttcacatcccctatttacttacaaaacaaaatttaaatccacatatttgctttcatttaagaaaaattatcctgcttttgtgttgatgatcacaatcatgtgtggcaatgatcgttacattactttcaaaacgaaggttatttttattttgtactttaatttcgaaagttataaacggagaccactatgttcattatttccagtaaaaatatgctccagaaggcccagcatgcaggctatgccgtgccagcctttaacatccataacctagaaaccttgcaggtggtggtagaaaccgccgcagaaatgcgctcaccgctgatcgttgccggaacaccaggcacgtttagctatgccggaatgggtaacattgtggcgatcgcgggcgatctggctcgtgaatacaatctgccactggccattcatctggatcatcatgaatcgttagccgatattgaaagcaaagttatggcagggatccgttcagtcatgatcgatggttcccactttccctttgaagagaatgtggcgctggtgaaaagcgtggtcgatttttgccatcgctacgacaccagcgtggaggcagaactgggccgccttggtgggatcgaagatgatttagtggtagacagcaaagatgccctttacaccaatccacagcaagcacgtgagtttgtggcgcgcaccggcattgattcgctggcggttgctatcggcacggcacacggtatgtatgccgctgaacctaaacttgattttgagcgactggcagaaatacgcgctctggtggatatccctctggtattgcatggggcatctggtttgccggaaagcgatattcgccaggccatcagccttggggtatgcaaagtcaatgtcgccaccgaactgaaaatcgccttctccgacgccttaaaagagtatttcctacaaaacccgaaagccaatgatccccgccactatatgcaaccagcaaaacaggcgatgaaagaggtggtacgcaaagtaattcatgtttgcggctgtgaagggcaactgtgaggaatcgcctgtgatctacacgctaacacttaatagcgcgattgatatgaatatatttagcgatcctttacagccaaatattgtcaatcgcactcaccacaccgagttttgcccaaatggtaaaggggtaaatgttgcgctggttctggatcactttcaaatacctgcgcatatattaggcatttttggtggtttcaccggacattatattgtagaaagcctgcgtacccgaaaaatgccagtcacaccagcatgggtagaagaacccacgcggattaatattttcattcatgacggcaagcaggaatataaactggtcaaccctggctcatatattccagatgaatgtaaaaaacaaattatcacgattatttcgcaactgcccgatgcagaatatctggtgataagcggcagcctgccacaaggtattgaaagtcgcttttacgcagaaattatgcatatttgtcagcaaaaaaatatcggcgtaattttagatattagtcatccgtcattacgtcagttactggagttcaaaccgttattaattaaaccaaatgatgaagaggttaaagcaatattcggtttaactgtctctgacgacaatgatgcgaaaaatactctaaccactttacatgcacttggtgcacaaaatgttctgctaacccttggcgctaaaggaatgtatttctccaatgggattgattactggttttgtagcgcgccaacggttgatttggtgagctccgcctgtgcaggcgatgctgcactggccgcctttctcagccagtggttatctacaggagaagtggaatatgccttatctcttgccagtgcaacaggagctgatgtcgcaagttctgccggactaggccaacttgcggcaatagaaaccttactttcgcaaatccacgtcagaaagctgtaggttaaattacaatataagttctgcttatgaaaaagatcattgcagtgaccggctgccctaccggtattgcgcatacatttatggctgaagaagccttaaaaaatgccgcgaaaaaattatctgttgaaataaaagttgaaaccaatggtgccagcggtgttgaaaatgccattcaacctgctgatctggtagatattgccggagtcattattgcggcggataaagatgtcttacctgatcgctttaatggtttaccggttattgaagtaccggtaaaagaagcaatccatcatcctgcggagctgattaacaaagttattaatggtgaagccccaatacgtaaaggcgaatcaaccaccagcacggaaattatcgaaaaagaatcactggggcgacaaatttataagcacctgatgagtggtgtttcaaatatgctaccttttgtagttgccggaggcatattaattgcggtgtcgcttttatgggggatttattccgctgatcctaattcagctgaatacaatgcaaccgccgcaatgctaatgaaaatcggtcagcaagccttttcgattatggttccggtctttaccgcttatattgcattctctatttctggcagaccagggatggtggctgggtttgtcggcggcttactggcaaatactaccggagcaggatttctcggtgggataattgccggattcgccgccggttacctgatgttatgggtaaagaatcgactcgaaggcttaccgcgtcagtatgaaggcctgaaatcgatttttattatgccgctcattggcgtactggttattggcgtgttgatgtcgctgcttgggcaacctgtcgcagctatcaataatagcatgatgaactggctggcatcgctacaggaagcgaatccaatattgctgggtattgtggtgggtgcaatgtgctcttttgactttggcggcccggtaaacaaagccgcttatgtcaccggcacgcttttactgggccagggcaacttctactttatggctggtgtgtctgccgcatgtattactccaccactggtaattgctctggcgaccaccttctttccaaaaggttttagcgaggaagaacgtgccgcaggcatggttaactatatcctcggttgtacacacatcactgaaggcgcgattcctttcgcagcgaaagatcctttgcgtgtcatcccgatgatgatgattgcttccagcatttccgcagtacttagctacagcttgcgtattcaggttccggctcctcacggcggcttcttaattttacctttggtgagtcagccgctggcctgggtgttatgtatccttgcgggatctgcatgtggtgcgatgatgcttggcctatggagattgtgggctgtgcgcaaaaattcagtcaacacaactcctgtagcaaaggctggaggtcagaatgcagctctgtgaacacgatatttttatcagcgatgagcgcctcgataaagtcaccgctctgcaccgcgtggtggaaaagttatctgcggctggcaataccacgcctgactatttacgcggcatgttggatcgcgaagcacagatttccacttatctgggaaatggaatcgcgatcccacacggtacgccagaatctcgcgatgcggtattacaaaccggtgtaaaggtaatcgtttttcgccacggcgttgactggggtgacggcaataccgcgtatctggtcaccggaattgccgcgcgctccaatgaacatcttgagattttgcgccaactgactcgcgtgctcagcgatgacgctattctgcaagcactggctaaagccgaatcccccagtcaggttttagcgctactgactggctcgacgaccaatacgccagcagccatggagttgcacgagggtgagcaggcaacatttgtcatccataatccgcatggtttacatgccagacccagtgcggtactggtgaagtttatcaaacagtttcaaagccacattacggtagaaaatctggataacgcctccggcccggtggacggaaaaaacctgatgcgagtggtgtcgctcggcgcgaaaaaggggcatcgcttgttgttccgggcgcagggcgaagatgcacagcaggcactacgtgaaatcggggagcttatcgcctctggtgcaggcgagatgatcaccgttcccgttaccccaccaccagaagtcatgcagccaaagcgcagttggctatctcgattgtttaattagccttcatttgttcctccgtgcccgctccggcgggtacggtttttcatgacaaagtgaagttacagacattacacaccatttcgttaccttacattttctttcgcaactttcatttatcagatcaaaatcacaaaacaacattacgaaagcctataaattctttcgaagaataaaaacgaaagaactcggagataaaagtgaaagaaataattgctcgtcataaagcaggagaacatctgggcatctgttcagtttgttctgctcatcccctggttatcgaatcagctctgcttttcgatctcaatactgacaacaaggtattgattgaagccacatccaatcaggtgaatcagtttggcggttataccggaatgaaaccggctgattttcgtgattttatttatggcattgctcaggaagtgggatttccacgtgagcggttgattcttggtggcgatcatttagggcctaactgctggcagaacgaaccggcagcggcggcaatggaaaagtcggttgagttaataaaagcgtatgtcgccgctggttttagcaaaattcacctggacgcgtcgatgtcctgcgctgacgacccgacaccgttggatccgatggtcgttgcacgccgtgccgccgtgctttgtaaagcagcagaagagaccgcaaacgaagaacaaaaatgccatctgacttatgtcatcggcacggaagtgcccgttcctggcggtgaagccagtaccatcggcagcgttcatgtcacccgcgaggtcgatgctgcccgtacgctggaaactcaccaaatcgcgtttcgtgaatcaggtctggaagaagcactgtcacgcgtgatcgccattgtggtgcaaccgggcgttgaatttgatcatacccagattattcattatcagccgcaggcggcacaggcgctctccgcatggatcaaagaaacgccgatggtctatgaagcgcattcgactgattaccaaactcgccaggcctaccgcgccctcgttcgcgatcattacgccattctgaaggtcggccctgcactcactttcgccctgcgcgaagccattttcgcacttgcgcaaatggaaaacgagctgatctccccggaacaacgtagccgcgtgatggaagttatcgatgaagtgatgctaaacgagccaggctactggaaaaagtactaccgccccacctagagccaggcgatggtcgacatccactttagtttgtctgaccgtattcgctattactggccgcacccgcgtattcgtcaaagcgtagagaagttaatcgccaatctgaataacgtcacattgccgctgggattaattagccagtttatgcccgtacagtttgaacgcctgtctgagggcgtgctcacccccacgccgcataacctgattattgacaaaattcaggatgttctgcgcgcttatcgcttcggttgcacgccggatgtcgcctgaatagtggagaatttatgagccaattatttgtccgaaccggaatcacattcgactcgagccaacaggcgctggcgcacattggcaaagagatgctggcgaaaggcgtggtacatgatagttatccgcaggcactggtggaacgtgaagcgtcctttcccaccggcattgcgctggagcgccacgccgtcgctatccctcattgcgaggcagttcatgcgaaatcacccgctatctatctgattcgtccagataagccggtcatgtttcaacaggcggatgatgacgaagagattgccgtttcgttaatcatcgccttaatcgttgaaaacccggcggcacagctaaaacttctgcgccgtctgttcggggcattacaaatcccggacaccatagaagccttactgagcgccccggatgccgaactggcgtcgtgctttgagcacaaagtccttacggctgagcagtgcgtccaggtttaataataaattgataataatgaggaataccctatgaaacgtaaagtaattgtggcctgtggcggtgcggttgcaacctcaacgatggctgcggaagaaattaaagagctatgtgatgccaaccatattgagctcgacttagtgcaatgccgggtcaccgaaatcgaaacctatatggacggcgccgatcttatctgtaccactgccagggtcgatcgcgcctttggcgatattcccgtcgttcacggtatgccttttgtttccggcgtgggtattgaagcattacagcaaaaaattctgtccattctcatggggtaacgtatgtttagcgaaataatgcgttatatcctcgacttaggcccaacggtgatgttgcctctggtgatcatcgtgttctctaaactgctgggaatgaagcttggggattgttttaaatcgggtttgcatattggtatcggcttcgtgggtattggtctggtcatcggcctgatgctggattctatcggccccgcggcgaaagccatggcggaacatttccaaatcaatctccacgttattgacgtcggctggccgggttcatcgcccatgacctgggcgtcacaaatcgcgctggtcgcgatccctgtcgccatcggggttaacgtcctgatgctggtgacccgcatgacccgcgtggtgaatgtcgatatctggaatatctggcacatgaccttcacgggcgccatgctgcatctggcgaccggttcatactggctggggattctgggcgttgtggttcatgccgcctttgtctacaaactgggggactggtttgccaaagatacccgcgactattttggcctcgaggggattgctatcccacacggctcatccgcgtacctgagccccgtggcggtgctcgttgataccattatcgagaaaattccgggtctcaatcgtattcactttagcgcagacgatgtccagaaacgcttcggaccgtttggcgagccggtgactgtcggcttcgtgatggggctggtgattggtgtactggcaggctacgacaccaaagccgttctgcaactggcagtcaaaaccgcagcggtgatgctgcttatgccacgcgtcattaaacctattatggatggcctaacgcctatcgccaaacatgcgcgtaaacgtctacaggccaaatttggcgggcaggagttcctgataggccttgatccagcgctactgctcggtcatacctctgttgtctccgcgagcctgatattcattccgctgaccatcctgattgccgtcttagtaccggggaaccaggtgctgccgttcggcgacctcgccaccatcggtttctttattgcgatggcggttgcggtacaccagggcaacctgttccgcacgctgatttcaggtgtcattattatgggtatcaccctgtggatagccacgcagacgattggcctgcatacccaactggctgccaatgccggagcgctaaaagctggcgcacaagtcgcctcgctggatcagggcggttctcccatcacctggctgctgattcaactttttacctggcagaatatcgtcggcttcgccgtcattgccattatctatctggccggcgtactgctgacctggcgtcgcgcccgacagtttgtcgcggctgagaaagccacggcgctacagcaaagtcaaatcgcctcttaattttaggggagcaatcgctcccctcaccttcctggagaatgttatgaaatcagtggttattcacgctgagggagacgtgcgcgttgaagaacgtcccttaccacaactgcaagccgaggacgatgtgttggtcaaagtcgttagctcagggctttgcgggtcggatatcccgcgtattttcgcgcagggcgcccattattatcctattacgttaggccatgaattcagcggctacgttgaatcctacggcacaggcgtaacggatatgcagcctggcgatgccgtcgcttgtgtcccgcttcttccctgctttcactgtccgcaatgcgaacgcggttacttttctttatgcaaacagtatcagtttgtaggatcgcgcagcgaaggcggtaatgcggaatatgtggtggtcaaacgggccaatcttttccgcttgccgtctgatatgccgattgaagatggcgcgtttatcgaaccgattaccgtgggcttacacgcctttcatctggcgcagggctgcgaggggaaaaacgtaattatcgtcggggccgggacaattggcctgctggccttacagtgcgcgcgggaactgggcgcgcgaagcgtaacggcgattgatatcaatccgcagaaactggaactggcgaaagcgctcggcgcaacgcatacctgtaatagccgggaaatgaccgccgacgacatccagaccgcgttgtccgacattcagtttgatcaactggttctcgaaacggcaggaactccccagaccgtctcgctggctatcgatatcaccgggccgcgcgcgcaactggcgctggtggggacgttacatcacgatctcaccctgacgacgcgtacattcgggttaattttgcgtaaagagctcacgctcctcggcagttggatgaactactccgcgccatggccaggagaagaatgggaaaccgcagcgcgcctgttggctgaaaaacgtcttcaactgacccctctcattgcccatcgcggcgatgcggaaagctttgcagaagcagtcaaagcgcttaatggcgcgcccatgcagggcaaaatcttacttcaactttcctgatggtacgagccagcaacctgcgctggctcacatttcctttcgaaatttagcgttcacctttcgcaatccttcgtttaaactagttacagttaattatcaggcaaatcaatatgaactcatttgagcgaagaaataaaattgtcgacctgattaatacgcaaggcagcgtgctggtgatggacctttcaaatacctttggtatttctgaagtgactatccgtgctgacctgcgtctgctggaagagaaaggccttgtcacccgttttcatggcggcgcggcaaaaccgggaagtcatctggcggaaggcgacaatcaggaagtcattctggaagatcggtatcaactcgccagcgatccgaaaaagcggattgcccaggcggctgcggcaatggttgaagaaggaatgaccatcattctggatagcgggagcacaacattactaattgcggaagcgctcgcgcgaaaaagcaatattacggtgatcactaacagcttgcctgccgcttttacgctatcagaaaataaagatctcacgctggtggtttgcggcggtacggtacggcataaaacccactcaatgcacggcacgattgcggaacgatcgctacacggcatcagcgccgatgtcatgtttgtcggggcggatggcattgatgcgacaaacggtattaccacgtttaacgaaggttattccattagcggcgtcatggcggcggcggcgcacaaagttatcgcggtactggacgcgaccaaatttaaccgtcgcggctttaaccaggtattgccgatggacaagatcgactgtgtgataaccgatgacaccatcagcaaacaggataaagcggcattagcgaaaacaggcgtggaattaatgatcgtctaaaaaggagtcggttatgcattgctgatcgcgagagtaagcccaaaggaaaggtccggcccgctatcaccgcccaatgcccccatcactttacccacatcaatcacctgattgagtattaacgtgatggcgataaaaggcggttcccgggcgctcgcttttactcttcctgctgcgccagcgcatacttatacagcgcatttttcttcacgccgtgaatttctgctgccagcgccgccgcttttttcagcggcagctctgcctgtagcagcgccagcgtgcgcagcgcgtcggcgggcaggtcgtcttcttgcgctttatgcccttcgacaatcagcaccatttcgcctttgcgacggttttcatcttctttgacccacgccagcagctcgccgaccggcgcgccgtgaatggtttcccaggttttggtcagctcacgcgccagcaccacgtaacgggattcgccccacacggccaccatatcttccaggctatccaacagacgatgggtggactcataaaaaatcagcgttcgtggctccgcttcaatggcttttagcgcatcacggcggccttttgatttggcaggcaggaagccttcataacaaaaacgatctgatggtaaacctgcggcgcttaatgcagtgatagcagcacacggccctggtagcggcaccacgcgaatccccgcttcacggcaggtacgtaccaggtgatagccggggtcattaattagcggcgttccggcatcggaaaccagagcaatgttctgcccctctttcagcttcgcgaccagcgtttccgctttttgttgttcgttatggtcgtgcagcgcaaacaaccgggcattaatcccaaaatgttgcagcaataaaccggtgtgacgagtgtcttcagcggcaattaaatcaacggcttgtaaaacttccagcgcgcgttgggtaatatcagccaaattcccgataggagtaggtacaataaagagttggccctgagaattatccgccgattcgttttgtttcattgtgtcgtccgtattgccgatttaatattgagcattgcgtaaaaaaatatcactggatacagtatggtaccctcaacattttctcgtttgaacgccgcgcgcgcgctgcctgtcgtcctggctgcgctacttttcgccgggtgcggcacccaggcgccagatcaaagcgcagcctatatgcagggttcagcgcaagctgattccgccttttacctgcatcagatgcagcaaagcgcagatgatagcaagaccaactggcaattactcgccattcatgcactgctgaaagaaggaaaaagccagcaggccgtcgagttgttcaatcaacccccgcaaaatctgaacgatacccagcgtcgcgaacaatctttattagcggtagagatcaaactggcgcagaaagatgtggcaggcgcgcaggccttgctggataaactaaaacccgccgactttgcgccacatcagcaagcgcgttactgacaggcgcagatcgttgccagccagggacgcccgtcgcttaccctgttgcgggcgttaatcgcccaggaaccgctactggcggcgaaagagaaacaaaaaaatatcgacgccacctggcaggcgctctccgccatgacgccggatcaggccaggacgttagttatcaacgccgatgaaaatgtgcttcagggctggctggatctgcaacgcgtctggtttgacaaccgcaacgatccagacatgctgaaagccgggatcgccgactggcaaaaacgctacccgcaaaatccgggggcgaaaatgctgccgacgcagctcgtcaatgtacaacgttttaaaccagcttccaccagcaaaatcgctctgctgctgccgctgaacggtcaggctgccgtgtttggccgtaccatccagcaaggtttcgaagccgcgaaaaacctcggcacccaggcggtggaaatgcagcctgtcgccgcgcctgacgcgccggtcgaaccaagcgtggaggagacgcaaccacaaatgaccaacggcgtcgccagtccgtcgcaggcctcggtgagagatctgactgatgacgctccatcccagtctgctacgccagtcagcgcgccacaaactccccctgcgcagcctgctacagcaagcgcgccggcggatccctccgctgaattaaaaatctacgatacctcttcccagccgttggatcaggtgctcgctcaggttcagcaagacggcgccagtatcgtggtcgggccgctgttgaaaaacaatgtggaagcgctgatgaaaagcaacacgccgctcaacgtgctggcgctcaaccagccggaaacggtacgtagcttccctaatatctgctatttcgcgctctctccagaagatgaagcccgtgacgcggcgcatcatatttatgagcagggcaagcagtcgccgctgctgttgatcccacgcagcgcgcttggcgatcgcgtggcgaatgccttcacccaggagtggcaaaaactgggcggcggcatcgtgttacagcaaaaattcggctccgtagccgagctgaaaatgggcgtgaacggcggcgcgggtatcgcgttgacgggcagtccggtcgccgccagcgtgcctgcgcagccgggcgttaccattggcggtctgaccatccctgcgccgccgaccgacgcgcaaatcaccggcggcggacgcgtagacgcggtctatattctggctacgccggaagagattggctttatcaaaccgatgatcgccatgcgtaacggcacccagagcggcgcgacgctgtatgccagctcccgcagcgcgcaaggcacctccggccctgacttccgtctggagatggaaggtttgcaatacagtgaaattcccatgctggcaggcggcaatacgccgttgatgcagcaggcgctgagtgctgtacataacgactattctctggcgcggatgtacgccatgggcgtggatgcctggacgctggcgaaccacttttcgcagatgcgtcaggtgcaggggtttgagatcaatggtaataccggcgcattaaccgccagcccggattgtgtgattaacaggaagttatcatggctcaaataccagcaaggggagattgttcccgccagctaacacgtaaacaggctggcgacgcgtgggaagctgccgcgcgtctctggctggaaagcaaaggactgcggtttatcgccgccaacgtgcgcgagcgcggcggcgaaatcgatctgatcatgcgcgacggaaaaacgacggtttttgttgaggttcgctatcggcgctccgggctttatggcggcgcggcggctagtgtgacccgcagcaagcaacacaaattattacatactgcccgcttgtggctcgcccgccagaatgggagttttgatactgtggattgtcggttcgatgtgttagccttcaccggaaatgagattgagtggtttcgggatgcgtttaacgaccactcataattgaagattttaaggattagcgtgctcgaaagaatcaaagtttgctttacagaaagcattcaaactcaaattgctgcggcggaagcgcttccggatgccatttcccgcgccgccatgacgctggttcattccctgcttaacggcaacaaaatcctctgttgtggaaacgggacgtccgcggccaacgcacagcattttgctgccagcatgattaaccgctttgaaacggagcgacccagtttacccgccattgcactaaataccgataatgtggtcttaactgcgatcgctaacgatcgcctgcacgatgaagtttatgcaaaacaagtccgggcgctgggacatgcaggcgatgttttattggcgatctctacgcgtggtaatagtcgcgatatcgtaaaagccgttgaagcagccgtcacacgtgacatgaccattgtggcgctaaccgggtatgacgggggcgagctggccggactattagggccgcaggatgttgaaattcgtatcccttcacaccacagcgcgcgcattcaggaaatgcatatgctgacggtaaactgcctgtgcggtttgatcgataacacgctttttcctcaccaggatgattaaggagtacacatgaaggcattttcgccgctcgcagtccttatttctgcgttgctattgcaaggttgcgtcgccgccgcggtagtgggtacggcagccgtcggcaccaaagccgcaaccgacccgcgtagcgtgggcacccaggtggatgacggaacgctggaactgcgtgtcagcagcgcgctgtcgaaagatgagcaaatcaaaaaagagacgcgcatcaatgtcactgcttatcagggcaaagttttgttagtgggccagtcgccaaacagcgaactctccgcacgcgcgaaacagatagcgatgggcgttgaaggcaccaccgaggtctataacgagattcgccagggtcagcctatcggcctggggaccgcctctaacgatacctggatcaccacgaaagttcgctcacagctactgaccagcgatcaggtaaaatcgtcaaatgtgaaagtcaccaccgagaatggcgaagtgttcctgctgggcctggtgactgaacgtgaaggtaaagcggcagcagacatcgccagccgggtgagcggcgtgaaacgcgtgaccaccgcctttacgtatattaagtaaccggtgtgccgggtggcgataaaaatgtgtaaatcgcgtcgccatccggtaaatcatccggcttcgctaccccgctttttcccgcagttgcgatgaggtcagaatcgtcacgccttcttgtgctggctccagcgcttccgccagcatggcccgcgccacatcccgcgcatcgatcgatttccagtttcctggcagcagccggaatagcggagcgaaaagcgtttcattcacccgccgcgttgttctgtcgccgagcagcatagaaggccgggcaatcgtcaaacgaggccaattttgcgcgattaacgcctcctccatttctcctttcacccgattgtagaaaaacggagagtgcgcgtttgctcccattgcgctgaccaccaacatgtgctgcgcgcccagtcgacgcccggtcagcgcggtatcaaccaccagcgtataatccgcatgaataaacgccgctttacttcccgcttcacgccgggtcgtgcccaggcagcaaaaaacaatatccaccgggtcggtcacctgagctaacgcgtcggtaagctgcggatcgtgagggttataaacgccgacaatatccgtcagcgggcgacgcgttggcgcggcgatcgcgctcacctgcggcgtgttgattaacattctcagcagatgtccgccgaccagtccggtcgcgccggtaatcagtacctgactcatcctcgctcctttacagatttgtccaccttgcactctcggccctatcgaccaggcttaatagtctacgaggtaagtatccatcattgtggaaaatttgccttacccgacgccaccactgcggaggaaacgcatgagtaagaaaattgccgttttgattaccgatgaatttgaagattcagaatttacctcgccggctgcagaattccgtcaggccggccatgaggtcatcaccatcgaaaaagaggcgggtaaaacggtgaaaggaaaaaaaggcgaggccagcgtcaccattgataaggctattgatgacgttcgtcccgacgagttcgacgccttgctattgccgggaggtcattcgccggactacctgcgcggcgacagccgtttcgtggattttacccgcgatttcgttaacagcggtaaaccggtttttgccatttgccacggcccgcagttgttgatcagcgccgatgtcattcgtggccgcaaactcacggcggtgaaaccgattattatcgatgtgaagaatgcgggcgcggaattttacgatcaggaagtcgtcgtcgataaagatcagctggtgaccagccgcacgcctgacgacctgccggcatttaaccgcgaggcactacgcctgctgggcgcgtgagtcacgtaaccagtgcagttttttaccaaaccccagcgtgttgtcggtgaatttaatttcatccagccgaatttcccataccggcgctggcagcaccctggcgaccgggaagcgacgaagataagctttacgcgcggcgtcgctctcctgcccctccagacggcgaatttcccctttaaactgcacgccgcgaatgcgcgccaccgttttcggctgaccattgaccgttcccgcaactggcgcgcacgcgccggacatttgcgcatggcgggttttatcatccgttaacagatacagcgcgacgttttgcgcatcgaacaaataaaacgcattggcgcaccacagctctccctcatggtgtacgcaccaggtcaccacgtgttgtttcgccagccaacggccaatagcggtaagtgtgtccatctttattctcgcttatactgggaacctgaaaattatcatgctgatggcgacaatgacaccctggtatctgtatctgattcgtactgcagacaatgcgctttacaccggaataaccaccgatgtggcgcgtcgttacaggcagcatcaaacgggaaaaggcgcaaaagcattacggggaaaaggcgagttaacgctggcgtttgcggcgcaggtcggcgatcgctcgctggccctgcgcatagagtatcgcatcaaacagctcacaaagcgccagaaggagcgccttgtgacggaacgcgaagcgtttgaggcgctgctgtccagcctgcaaacgccggtgcttaaaaacgattgaagtggtcgtgatactccaccagccccgtcacgccctccagcgcatcctcagccaaacggtgtacctggaaagcgctttccgtaccgggccaacggcagtgaagatcgtaatgtgcggccagttcaaaaccgaagcggctatataacgccgggtcgcccagcgtcacgaccgccgcgtagccgaactcgttgagcgaatccagcccttcatacactaactggcgcgccagcccttgcccgcgatacttttcatcgaccgccagcggcgccatgccgacccactgtaaatcttcgccctgcacatcaaccgggctaaaggcgacatagcccactacctggccttcatcatccgtggccaccagtccgagcgtcagaaaaccatcttcacgcaaatcgtgaaccagcttcgcttccgcatcgctttcgaatgaacggcgtaacagcgcatcaataccaggcgcatcaatgggaatttctactcgaattagcatggttcacctaccgaggtctgtttggtttccggcgagtttttcattcccgcctcaacaaaatccgccagttgcagcagcataatgcgtaacgctttcggcatctgctccagttcgatggcgtccatcagattcttcacatacaaccctaactcagtatcgccttcaatgaccagtcgacgctggaaaaagagcgtatccggatcctgtttacgggcggcgatcattagcagatcgctggcgtcggcgctaaaactgacgtcagcatccgcctgctggctaacgatcagcttttcattttcaaccgtggtataccattttaagtcgatgtcacgaacatgaatgcttaaccaacgaccttcgaggaattccagctctccatcggccagcgcctgacgaaactgccagctcagaacctgttccagaacctggcgctttagcgcaaagggcgtcagtttaaccggtacactcatcagagacgggccagcatggactaagcgtgaacgcagtttatctaacacgagctttactccctgtttcaatagtcctgttattttgccatatccaataaatcacatggcggcgtaaatcaacaattgggtctgattttctaccccattattggtgttaccaatacgcctttaactgccttaaatcaaaaattgtcgcagcaaggttaactaaaatccctgttcgttaacaattttgcgtcgcagacgtaaccctcaggataaattatggagctgctctgccctgccggaaatctcccggcgctgaaggcggccatcgaaaacggcgctgacgccgtttatatcgggttaaaagacgataccaatgcccgtcattttgccggccttaactttaccgaaaaaaaattgcaggaagcggtgagttttgttcaccagcatcgccgcaaattacacatcgccattaatacttttgcgcatccggacggctatgcccgctggcagcgcgccgtggatatggcggcgcagcttggcgccgacgcgctgattcttgccgacctcgctatgctggaatatgccgcagagcgttacccgcatattgagcgccatgtttccgttcaggcctcggcaaccaacgaagaagcgattcgcttttatcaccgcaactttgatgtccaccgtgtagtactgccgcgtgtactgtcgattcaccaggtaaaacaactggcccgcgtcacgccggtgccgctggagatattcgcgtttggcagcctgtgcattatggcagaaggtcgctgctatctttcttcttacctgacgggggagtcgcccaataccgtcggcgcctgctctcccgcccgctttgtccgttggcagcaaacgccgcaggggctggaatcgcgcctgaatgatgtcctgattgaccgttaccaggatggcgaaaacgcaggctacccaacgctgtgtaaaggccgctatttagtggacggcgagcgctatcacgcgctggaggagccaaccagcctgaacacgctggaactgctgccggagctcatggcggcgaacatcgcttcggtgaagatcgaaggccgccagcgcagcccggcctacgtcagccaggtggcgaaagtgtggcgccaggcgatagatcgctgcaaagccgccccgcaaaacttcgttccacagcgcgactggatggagacgctcggcgcgatgtccgaaggcactcaaaccacgcttggcgcatatcaccgtaaatggcagtgagaggagctatgaaatattccttaggaccggtgctttattactggccgaaagagacgctggaagatttttatcagcaggccgcaaaaagcagcgctgatatcatttatctgggcgaagcggtgtgcagcaaacgtcgcgcgactaaagtcggcgactggctggaaatggcgaaatccctcgctgccagcggtaagcaggtggcgctctccaccctggcgctggtacaggcgtcatctgaattaagcgagctgaaacgctatgtggacaacggcgattttctgctggaagccagcgatcttggcgtggtgaatctgtgcgccgagcgcaaactgccgtttgtcgccggccatgcgctgaattgctacaacgcggtcacgctgcgccggttgctgaaagaaggcatggtacgctggtgtatgccggtggagctctcccgcgactggctggtgaatttgcttaatcagtgcgatgaactgggcatccgcaatcagtttgaagtggaagtgttgagctacgggcatctgccgctggcctactccgctcgctgctttaccgcccgttcggaagaccgcccgaaagatgaatgcgaaacctgctgtatcaagtatccaaacggtcgtgacgtgctctcgcaagagaatcagcaggtgtttgtgcttaacggtattcagaccatgagcggctatgtctataaccttggcaacgaactgacgtcgatgcagggattggtcgatatcgtgcggctgtcgccgttggggacggagacatttgccatgcttgatgcctttcgcgctaacgaaaacggcggcgcgccgttaccgcttgccgcccatagcgactgtaacggctactggaagcggctggccgggctggagctacaggcctagccggatggcagcatcaataccttatccggcctacaaatagcgctcccgaaggcccgataagcgcagcgccatcgggcattgtttttgccattagtctcataaagctcactttgttaacaacattcgctaatctttaatgcagtattaaaagattaatcggtaacaaagtgagccgttatgactgacaaaactattccgttctcggtgctggatctggcgccgatccctgaaggatcttcggcaaaagaagccttcacgcactcgcttgatctcgcacggctggctgaaaagcgtggctatcaccgctactggctggcggaacatcacaacatgaccggtatcgccagcgcggcgacctcggtattgattggttatctggcggccaataccacaacattacatcttggctccggcgacgtgatgctgcctaaccattcaccgctggtgattgccgagcagttcggcacgctgaatacgctctacccgggacgtatcgacttaggattgggacgcgcgccgggtagcgatcagccgacgatgcgcgcgctgcgtcgccatatgagcggcgatatcgataactttccacgcgatgtcgcagagctggtggactggttcgacgctcgcgatcctaatccgcatgtgcgcccggtgcccggctacggcgagaagatcccgatctggctgttgggctccagcctgtatagcgcgcaactggcggcccagcttggcctgccgttcgcctttgcttcgcatttcacgccggatatgttgttccaggcgctgcatctgtaccgtactcagttcaaaccttcagcgcggctggaaaaaccgtacgcgatggtgtgtatcaatattatcgccgccgacagcaaccgcgacgccgaattcctgtttacctccatgcagcaggcttttgtgaagctacgccgtggagaaaccggccaactgccgccgccgattgagaatatggaaaccttctggtcgccatccgagcagtatggcgtgcagcaggcgctgagtatgtcgctggtcggcgataaagcgaaagtccgccacgggctggtgtccattctgcgggaaacccaggcggatgaaattatggtaaacgggcagattttcgaccaccaggcacgcctgcattcgtttgatttagcgatggatgtgaagcaggaattgttggggtagcgcattgttttgcccggtggcgcttcgcttaccgggcctacagcatcaagtaggccggataaggtgcaaccgccatccggcacaataacgttactggtacaccggcagcaaattaaagctcgacagaatatggataaccgcgttgccgacaccgaagaccagaatcagggcaatcatcggtttaccgccccagacgcgaaattttgggctgccgaaacgttcgcgagatttgcgcgccaacagcgcaggcacaatggccgcccagatagttgcagctaaacctgcatagccaatggcgtacagaaaaccgttcgggtacagcaggccaccaatcatcggcggcaggaaagtcagcagcgccgttttaaaacgtcccattgccgagtcatcaaaaccaaacagatccgccagatagtcaaacagccccagcgtcacgccaaggaaggaactggcgaccgcaaagttagagaacaccaccagcagcagatccaggctgcggctgttcagcacgccgctcaacgcctgtaccagcacatcaatattgccgcctttctgcgcaatgccgataaattccggacgtgggatgttgcccatcgtccccagcagccagacggaatagagcgccagcgccagtaacgtcccataaatcaggcatttcacgatggtgcgcggatctttgccgtaatatttcatcaggctcggtacgttaccgtgataaccaaaagaggccagacaaaatggcagcgtcatcagcaggtacggcgtatatgacgcgtggctttcagccacgttaaacaacgtggtcggctgaacgtgccctaacaggctgccgaaggtcaggaagaaagtaatcactttcgcgcccagcacaatcgccgtcatccggctgaccgccttcgtactcagccacacgacaaacgccaccagcagcgcaaaggcaaaacctgccgctcgcgccggaacgttcagcgacatctcagcaaaggtatgatgcagaattgagccgctcgccgagatataggcgtaagtcaggatgtagagcacaaaggcaatagagatgccatttaccacgttccagcctttccccaacagatctttggtgatggtgtcgaaactcgaaccaatgcggtagttaaggttagcttcgaggatcatcagcccggagtgcagcatacaaaaccaggtaaagaccagcgccgccatcgaccagaagaaccacgccccggacatgaccaccggcagggagaacatccccgcgccaatgatggtgccgccgataatcaccacgccgccaagcagcgaaggtgacgtttgggtggtggtaagtgttgccattcagctctctctccagtcatttatagtgtgactatctctcaatacgttgcactgtaccagtacacgagtacaaaagaaataaaaaaagccccgattgtgacgatcggggctgtatattttactttacgctgtgaatgcgcaggtcagcgtgagttacgcatcaccgccgaaacgacggcgaccggtagagtcatcacgacgcggaccacggctttcacgacgttcgccgctgaagcgacgaccatcaccacgaccaccttcacgacgttcgccgctgaaattacgaccgccttcacgacgttcgccactgaagctacgaccaccgccgcgacgttcgccgcccgcgtgcggaaccgcatcacccaacagctgcatattcatcggcttgttcagaatgcgagtacgcgtgaagtgctggagcacttcgcccgacatacctttcggcagctcgatggtggagtgagacgcgaacagcttaatgttaccaatgtaacggctgctaatgtcgccttcgttagcgatagcgcccacgatatgacgaacttcaacgccgtcatcacggcccacttcaatgcggtataactgcatatcgccaacgtcacgacgttcacgacgcggacgttcttcacgatcgccacgcgggccacggtcattacgatcgcgcggaccacggtcgtcacggtcacggaattcacgcttaggacgcatcggcgcatccggcggcagaatcagcggacgctcgccctgcgccattttcagcagtgcggcggccagcgtttcgagatccagctcttcaccttcggcagacggctggattttcgccagcagcgcacgatactgatccagatcgctgctttccagttgctgctgaactttcgcggcgaatttttccagacgacgtttacccagcagttctgcgttcggcagttccacttctggaatggtcagcttcatggtgcgttcgatgttgcgcagcagacgacgctcgcggttctcaacgaacagcagcgcgcgaccggcgcgacccgcacgaccggtacgaccgatacggtgaacgtaggactcggagtccatcggaatatcgtagttcaccaccaggctgatacgttcaacgtccagaccacgtgccgcaacatcggtggcgatcaggatgtccagacgaccatctttcaggcgttccagagtctgctcacgcagcgcctggttcatatcgccattcaacgcggcgctgttgtagccgttacgttccagcgcttctgctacttccagggtcgcgtttttggtacgtacgaagataatcgccgcatcaaagtcttccgcttccaggaaacgcaccagtgcttcgtttttacgcataccccagacagtccagtagctctggctgatgtcaggacgggtagtcacgctggactgaatgcgcacttcctgcggctctttcataaagcggcgggtaatgcgacgaatcgcttccggcatggtggcggagaacagagcggtttgatgaccttccgggatctgcgccataatagtttcaacgtcttcgatgaagcccatacgcagcatttcgtcggcttcatccagcaccagaccactcagtttagagaggtcgagggtgccgcgttttaagtgatcaagcagacgtcccggcgtaccgacaacgatctgcggcccctgacgcagggcgcgtaactgcacgtcataacgctgaccgccgtacagggcaaccacgtttacgccgcgcatgtgtttagagaaatccgtcatggcttcggcaacctgtaccgccagttcgcgggttgacgccagcaccagaatctgaggtgccttcagctcaggatcaagattgttgagcagcggtaaagagaacgctgcggttttgccgctaccggtctgggccatgcccagcacgtcgcgaccgcccagcagatgcggaatgcactctgcctggattggagatggtttttcgtaacccagatcggtaagggcttcaaggataggagccttcagccccagatctgcaaaagtggtttcgaattcagccatgtagtacgtgtgcctcaaaattaatggcggccagtctacataactcatcatgaaattgatctgcaattttcattgaaaagtgtgaaccggctcaaagtaggtgtattaacgaacaacaacgccctcacccgcgaaggtgatggcaatcaaaaagattacgggctgatatgttcgtcagctattgctggtccgattctgccaggtcatcttggtcctggcccaggagcgataattccaacaatgcgtatcggtgctcaacaaagttatgaacgttgttggccaccgccagtttgaacagagccgtggcgctgtccaaatcccccagacttaggtaatacttacctaaatagaagttggtttcactgagatgctcagcgagcgaggtgttatccgttgcgtccgccttgagcctttccatcagcgttgcttcgctaatgtcgcccaggtagaactcgacaatgttccatccccattgctctttatccgatttttcgaagcgtgcttttaacgcttctttcgcctgcttctcattaagcttctgctcaacaagatacagccacaggctgcggtaaggatcattgggatcgtcttgataaaacgccagcagatcatcttgcgctaacttatcacggccgccgtaatacaatgcgataccgcggtttaagtgcgcgtagttgtaagttggatcaagctctagtacagaatcaaacgcttcataggcagcatcaaaattgcctgcctgcgttaaataaatgcctaagtaattgaatacttcaggcatatccggtctgattgccagcgcttgtgaaaaatcatttcgcgctaatgccctcaaaccaagactatcatacaacactccgcgctcatataaaagctgtgcgcgttcgtcatcggttaaagcccgactggcaagaatctgttccatacgcgccagaatcacttcctgctgtaaagtcggttgcaatggtactgcgaggacttcacttttacgccaggcggaattactgcatcctgcaagcgtaagtgctgtcgcaacgaaacaccagcgcaaaaaaggcttcatttcccactcccgaagacaacgattgaatgaacgtcctgttccccggtggctcaacaaggcgtccagccaggtctaaagccccccgcactgcggagggcaaaaggctaccttactcggcctgttcgctcgccggagcttccggcgcagccgcaggttgagactgctcggttgcttctttaatgctcagacgtacacggccctggcggtcaacttccagaaccttaaccgggacttcctgacccatctgcagataatcggtcactttctctacacgcttatccgcgatttgagagatgtgaaccagaccttctttaccgccgccgatggcaacaaacgcgccaaagtcaacgatacgggtcactttactattgtagatacggccgacttcgatctctgcggtgatctcttcgatacgacggatagcgtatttcgctttttcaccgtcggtcgccgcgatcttcacagtaccgtcatcttcaatttcgatggtggtgccggtctcttcagtcagcgcgcggatcacagaaccgcctttaccgatcacgtctttgatcttgtccgtgctgatcttgatggtatggatacgcggcgcaaattcagagatatcgccgcgcggcgcgttgatcgcctgttccatcacgcccaggatgtgcagacgcgcacctttagcctggttcaacgcaacctgcatgatctctttggtgataccttcaattttgatatccatctgcagcgcagagataccgtcgcgggaacccgccactttgaagtccatatcgcccaggtgatcttcgtcgcccagaatgtcagacagtacaacgtagttgtcgccttctttcaccagacccatagcgatacctgctacggcggctttaattggcacgccagcgtccatcagcgccagagaagcgccgcacacggaagccatagaagaagaaccgttggattcggtgatttcagacaccacgcgaacggtgtacggaaatttatccatgtccggcatcactgccagcacgccgcgcttcgccagacgaccgtgaccaatttcacgacgcttcggagaaccgaccatgccggtttcgcctacggagtacggagggaagttgtagtggaacaggaagctgtcagtgcgctcgcccatcagttcatcaagcacctgcgcgtcacgggcagtacccagagtcgcggtaaccagcgcctgcgtttcaccacgggtaaacagagcggaaccgtgagttcgcggcagtacgccagtgcgcacgtccagaccacggatcatgtctttttcacggccatcaatacgcggctcgcctgccagtacgcggctacgtaccacgtttttctcgatggcgtgcaggatttcacccagctcgttagcatccagagtttcatcttctgcaataagctgctcgatggtttcggatttgattacgtcaacctgagcatagcgctcttgtttatcggtgatgcggtacgcgtcgctcagacgagattcagccagcgcagcaacacgcgcgttcaacgcgtcgttgacggcttccggctgccagtcccaacgcggtttaccggcttctttcaccagatcgttgatcgcctggataacaacctgctgctgctcgtgaccgaataccaccgcgcccagcatagtgtcttcgctcagcagttcagcttcggattccaccatcagcacagccgcttcggtaccggcaaccaccaggtccagcttgctttctttcagctcgtcctgggtcgggttcagtacgtactggtcattgatgtaacctacgcgcgccgcgccgattgggccgttgaacggaatgccggacagcgacagcgcagcggatgcgccgatcatcgccacgatatccgggttaacctgcgggttaacggaaacgacggtcgcaataacctgcacttcgttaacgaaaccttccgggaacagcggacgaaccgggcggtcaatcagacgcgcgatcagggtttcgccttcgcttggacggccttcacgacggaagaagctgcccgggatacgaccagcagcgtaggtacgctcctgatagttaacggtcagtgggaagaagtcctggcctggcttggcttttttctggccgacaacggtaacgaatacggcggtgtcatccatgcttaccataacagcggcagtggcctgacgcgccatcatgccagtttccagcgtaacggtatgctggccgtactggaattcacgaacgatcggattaagcaaaataatatcctttccaatttttgacggcacaatacgcgccgtcgttaatacccgatcttctgcgcatcctcgcgactaatgacaaccctaaccctgatatgggtaaagcctctcattagccgcgcgaacctctgcaacggaagatcattcatagcaacaatacattagtttccagcgaattgctgccatctgctggaaaaaaggggccatgaaggccccctctttctgaaactcgaaagaattagcgacgcagacccagacgctcaatcagcgcggtgtagcgtgcaacatctttacgtttcaggtagtcgagcagtttacgacgctgagaaaccatacgcagcagaccacgacggctgtggtgatcttttttatgctctgcaaagtgaccctgcaggtggttaatctgtgcagtcaacagagcaacctgaacatcggtagaaccggtgtcgtttgcgtcacgaccgaactcagaaacgattttagctgtagcttcagtacttagagacattttaaaactccaaagtatttaagaatgagaggacgccgatctctaattcagcgatcccagtgtacgccgcgtaaactgttaaataatttacgcgacgttaagcggcggtattctactcgcagcgctctcttatcgcaagacgaagcgacattacgccgggtactctactaccagccgacgaggcgcgacacggccttcgtcgtcaatttcgcccataccgataaatttatcgtcttcaccttccgtcacacgaaccagtcccttcaacggcgcgcccgtggtacgaaccgggttgccatttttgaagtataccgaagatgttaacggcagattaacaacaggatagtccgaagccggactatccattggcatcaataatggatcgagcaactgcgccgccggaacgccctgctgttccgcctgtgctaccagcgtctgcaagtgctccagcgtcaccatacgatccaccggatacttgctgaccgtcagacgacgcaggtacgttacgtgcgcgccacagcccagtttctcacctaaatcatcaataatagtgcgaatataggtgcctttggagcaatgaacttccagctccagctcgttaccttcatggcgaataaacagcagctcatagacggtaatcgggcgggcttcgcgcggcacttcgataccctggcgggcatattcgtacagcttcctgccctgatacttcagcgccgaatacatcgagggaatctgttcgatatccccacgaaaggtctccagcgcgctcgcaagctgctcagcgctgaaagtcaccggacgctcctgcacgatttgaccatcggcgtcagaggtatctgtgcgctgccccagacgggcaataacacgatagcgtttgtcagaatccagcaagtactgcgaaaattttgtcgcttcgccgaggcaaatcggcaacatgccggtcgccagcgggtccaacgcgccggtatgcccggcgcggttggcattgtagatgcgcttaactttctgcagcacgtcattgctggacataccctgcggcttatccagcaacagaacgccgtgaatgtcgcggccacgacgacgaggacgactcatcagtcctccttgctgtcgtccgggttcacacgacgttcttcgtcatgtttcaccacgttagtcaccaggttggacatacgcatcccttccaccagcgagttatcgtagaagaaggttagttccggcacgatgcgcagacgcatcgctttacccagcaagctgcggatgaaaccagacgcttcctgcagggccttaatgccgtttttcacagccgcttcgtcctgatcgttgaggaacgtcacgaatactttggcgtatgccagatcgcgggacatttcaacacccgatacggtggtcatcatacctacacgtggatctttgatttcgcgttgcaggatgagcgcgatctctttctgcatctcttgcgctacgcgctgcgggcgaccaaattctttcgccataataaattctccagaataaagacaaaaaaggggccataagcccctttttaaatttcttgccgggtggcgcttcgcttacccggcctacgcctaatcatcttctaaggattttggattgcaacaaggcggcaagctcgtaaatccccgggagcatagataacgatgtgaccggggtgagcgagcgcagccaacgccgttgcggcccaaaagacgacgaagattaagcgatggtacgttggatctcgataatctcgaacacttcaatcatatcgccaacgcgaacgtcgttgtagttcttcacgccgataccacattccatgccgttacggacttcgttaacgtcatctttgaagcggcgcagggattccagctcgccttcatagataaccacgttgtcgcgcagtacgcggattggattatggcgtttaattgtaccttcggtaaccatacagcccgcgatcgcgccgaatttcggcgatttgaacacatcgcgcacttcagccagaccgatgatctgctgtttcagttccggagacagcatgccgctcatcgccgctttcacttcgtcgatcaagttatagatgacggagtagtaacgcagatccagactttcggattcaatcactttacgcgcagaagcatcagcacgaacgttgaagcccaccagaatcgcgttggacgccgcagccagggtcgcgtcggtttcggtgataccacctacgccagaaccgatgatcttcactttcacttcgtcggtagacagtttcagcaaggagtcggagatcgcttccacggaaccctgtacgtcagccttcagcacgatgttcacttcgtgaacttcgccttcggtcatgttgacgaacatgttctcgagtttagatttctgctgacgagccagtttaacttcacggaatttaccctgacgatacagagcaacttcacgcgctttcttctcgtcgcgaaccacggtcacttcgtcaccggcagccggaacgccggacaggccgaggatttccaccggaatggacggacccacttccagcacttcctgacccagttcgttacgcatcgcacgcacgcggccgtattcgaagccacacagcacgatatcgcccttatgcagcgtaccttcgcgtaccagaacggtagccaccggaccacgacctttatccaggaaggattcgatcaccgcgccgctcgccatacctttacgaaccgctttcagttccagaacttcggcctgcagcaggatagcgtcaagcagttcgtcgataccggtgcccgctttcgcagacacgtgaacgaactggctctcgccgccccactcttccggcagaatgccgtactgggacagttcgttcttcacacgatccggatccgcttccggcttatcgattttgttcaccgcaaccacgaccggcacacctgccgctttcgcgtgctggatagcttcgatagtctgcggcatcacgccgtcgtctgctgcaacaaccagaaccacgatatccgttgcctgagcaccacgagcacgcatggaggtaaacgcggcgtggcccggggtgtccaggaaggtgatcatcccgttgtcagtttcaacgtggtaagcaccgatgtgctgggtaatgccacccgcttcgccagaggccactttcgtggaacgaatgtagtccagcagagaggttttaccgtggtcaacgtggcccatgatggtcacaaccggtgcgcgcggttcagccgcagcgccggtatcacggtcgctcattaccgcttcttccagttcgttttcacgacgcaggataactttgtggcccatctcttcggcaaccagctgtgcggtttcctggtcgatgacctggttgatggtggccatggcgcccagcttcatcatcgctttgatgacctgagaacctttcaccgccatcttgttcgccagttcgccgacggtgatggtttcaccgatcaccacgtcacggttaacggcctgagcgggcttctggaagccttgctgtaaagaagaccctttacgcttgccgcctttaccgccgcgaaccgcagcacgcgcttcttcgcgatcggctttggattcggcatgtttgccttttttcgccggacgcgccgcttttgcattacgaccacgaccacgaccaccttctacttcacgatcgttttcgtcttcggcctggcgcgcgtgctgagaagtggtgacatgatagtcactggtgtcttctactggctcaggcgttgcggtccatttgttttcttccgccatgcggcgagcttcttctgctacacgacgcgcttcttcttcgagtttgcgacgtgcttcttcttccgctttacgcttcagctctgcagcttcattctcacggcgggctttttcggcctgggcggttttggtcatatcgtcagtctgttgattgctcactttgtctttttccgcagcttcacgtttcgctttttcagcggcttcacgcttagcttgttctgcggcctcgcgttcagctttttgttgcgcctcgcgtttggcctgttcttctgcctcacgacgggcttgctcttccgcttcacgctgcgcctgctcttccgcggccaggcgttcagcctcttgcggatcgcgtttcacaaaggtgcgcttcttgcggacttcgatttgtaccgatttactttttccaccggtaccaggaatattcagggtgctgcgcgttttacgctgcagcgtcaatttatcggggccagaaaccgcttcgcggttcaggtgcgccagtaaagtctgtttttcttgtgcggacacagagtcgtcagcagatttccggatacctgcatcagcaaactgctgtaccaggcgatccacggaaacctgtctctctgcggccagcgcttttagggttaaatctgtcatgctgttccttcctgctacagtttattacgcttcgtcgccgaaccagcaaatattacgggcagccataatcagctcaccggctttttcgtcggtcaacccttcgatatcagccagatcatcaatgccctggtcggcgagatcttccagcgtacaaacaccacgagccgccagtttgaaagccatatcgcgatctaatccttccagattcagcagatcgtcagccggtttgttatcacctaggcttgcttcctggtcctgcgccagagtggccagtgcgtttttagcacgctcgcgcagtgcttcaacggtcggctcatcaaggccgtcaatttccagcagttctttcattggcacataggccagttcttcgagcgtggagaaaccttcttctaccagaacggtcgcgaactcttcatcaatatcaagatatttagtaaagatctcgatagcggcatgtgcttcagcctgatgtttagcctgcaagtcatcaacggtcattacgttgagttcccagccgctcaattgcgaagccaagtggacgttctgaccattacgtccgatcgcctgcgccagattaccggcttcaacggcgatatccatggtatgtttatcttcgtccaccacgatagacgcgacatctgccggcgccatcgcattaatgacgaactgcgccgggttatcatcccacagcacgatatcgatacgctcaccgcccagttcggtagagaccgcctgaacgcgcgcgccgcgcatccccacgcaagcgccgaccggatcgatacacttatcgttggttttcactgcgattttcgcacgagaacccggatcgcgagccgccgctttaatttcaatcacttcttcgccgatttccggcacttcgatgcggaacagctcgatcagcatttccggcttggaacgggtgacgaacagctgcgcgccacgcgcttccgggcgaacagcatacagcacgccgcgaatacggtcgccagggcggaagttttcgcgcggcagcatatcttcacgcagaatcaccgcttcagcgttaccggccatcccttcggatttaatttccaaagagatattgtcgcggttcactttcttcaccacgccagtgacgatttcgccttcctggtcgcggaactgatcgacaaccatcgcgcgttcagcttcacggactttctgcacgataacctgtttcgcagtctgcgtggtgatacggtcaaaggtgacagattcaatctgatcttcaacatagtcgccgacattcaggctttcgtcttcaaagcgcgccgcttccagcgtaatttccttcgtcggcatggtcacttcttcaacgatcaaccaacggcggaaagtatcaaaatcaccgcttttacgatcgatttctacacgaacatcgatctcctgctcatattttttctttgttgctgtcgccagcgcactttccagcgcttcaaaaattttttcgcgtggcagcgctttttcgttggagacggcttcaacaacagccaaaatttctttgttcatcgcgggcttttcacctcatccagactgttaaaagtggggaaccaggttcgccttctggatattactcagcgcgaacacttcatctttgccttcgactgtgacggtaatcatttcaccgtccaccgctttgataatgccctgccacttgcgacggttctgtaccgccatgcgaagaaccagcgcgacctcttcaccctggaaacgcgcataatgatcggcagtgaacataggacggtcgagacccggtgacgagacttcaaggttgtaagccacggagataggatcttcaacgtccagcaccgcgcttacctggtggctcacatcagcacaatcatcaacattgatgccatcttcactatcaatatagatgcgcagtgtggatgtgcgaccgcgaataaattcgatgccgaccagctcgtagcctaaggcttcaactggcgctgtaatcatctctgttaatttttgctctaatgtggacaagcccacccccaagacataaaaaaagggcctaaagcccagttattctgtagtcagataacaaaaaaccccgataaatcggggctttagataactgaaccctataaccgcaacggcggtctggtgtaccttccgaaagaatttttttcaaatccagctacgaaggacataatcttcacagtatatttgaaaaagaactctaagggaaagtggttgcgggggccggatttgaaccgacgaccttcgggttatgagcccgacgagctaccaggctgctccaccccgcgcctgaaacgtggcaaattctactcgttttgggcaaaatttgcaaatactgctgggatttggtaccgaggacgggacgtaaaatctgcgcacagtatagtgaccaggcatgagttatgtcaaccctattcccaatatgcagatgaatgaatatcactcttcgttatactcatcccacctctcctgcttatacacgcatttcacaacgttatttcagtaaaccttcactaaatgcttcctgtctctgctaaaagatgattaaatgaaaactcatttattttgcataaaaatgcactaaagcagaaaccgatctcattatcagtcaatcaagcagggttctattctatgacgacgattcttaagcatcttccagcaggtcaacgtattggtatcgctttttccggcggtctggacactagcgccgcgctgctgtggatgcgacaaaaaggagctgtcccatatgcctatactgcgaatctgggacaaccggatgaggatgactatgacgccattcctcgtcgcgcaatggagtatggcgcagagaatgcccgcctgattgattgccgcaagcagttggttgcagaagggatcgcaacgattcagtgcggcgctttccataatacgactggcggactgacctatttcaataccacgccgctgggccgtgccgtgaccggcacgatgctggtcgccgcaatgaaagaagacggcgtgaatatctggggcgacggcagcacctataaaggcaacgatattgaacgtttctatcgttacggcctgctgaccaacgccgagctgcagatttacaaaccgtggctggataccgactttatcgatgagctgggcggccgtcatgagatgtctgaatttatgattgcctgcggtttcgactataagatgtcagtcgaaaaagcctactccaccgactccaacatgctcggcgcgacgcacgaagcgaaagatctggagtttcttaactccagcgtcaagatcgtcaacccgattatgggcgtgaagttctgggacgaaagcgtgaagatcccggcagaagaggtgaccgtccgtttcgaacagggacatccagtggcgctgaacggtaaaaccttcagcgatgatgttgagatgatgctggaagcgaaccgcatcggcggacgtcacggcctgggcatgagcgaccagatcgaaaaccgtatcattgaagcgaaaagccgcggtatttatgaagcccccggaatggcactgctgcacatcgcttacgagcgtctgttgaccggtattcacaacgaagacaccattgaacagtatcattctcatggtcgtcagttgggtaaactgctgtatcagggtcgctggttcgactctcaggcgctgatgctgcgtgacggcctgcaacgttgggtcgccagccagattaccggtgaagtgacgttggagctgcgtcgcggcaacgactactccatcctgaacaccgtgtcagacaacctgacctataaggctgagcgtctgaccatggagaaaggcgagtccgtgttctcgccagacgatcgtatcggtcagttgaccatgcgtaatctggacattactgatacccgcgagaaactgttcggctacgcgaaagcgggtctgttaaccgcctcttccgcgaccggtctgccgcaggttgagaatctggaaaacaaagcgaagtaaacatttatcattctaaggccgcgaaagcggccttttttatgcgcggaatataaggtgtctataggcctgataaacgtagcgtcatcaggcgttgtaataatgtcggatggcggcgtaaacgccttatccgacctacagaaaatcacaaataacagacgaaaaaaaagacgcttttcagcgtctttctttcggaatattggtaccgaggacgggacttgaacccgtaagccctattaggcactaccacctcaaggtagcgtgtctaccaattccaccacctcggcacggatactgctattagcgcgggatatcgctggtcggctgggccggtgcagcaggttgagtctgctcggttttcgccggcgcgctcagattttcccactcgcttcctttattggttttgttgctattgatattacccaacaccagactgatgatgaagaacagcgtcgccaataccgccgtcattcgagtcatgaagttaccagaaccacttgaaccaaatagcgtagcggaagcgcctgctccgaaggaggctcccatatcagcgcctttaccttgctgcagcatgatcagacctacaaggccaattgccacaataaggaaaacaactaaaagagcttcgtacataatcaacctgttccttgcggagttgccgcgtaccaatgcttctaccaataaagcgggatttttactgtttcccactgaagcgggtgtgaatactaaccaaagcgaatgaccttcgcaagggcaatttaagcgcattgtatcaactgcggaaaaaaacagcaaaagcgttgttttttgcgggcagtaaggcggcaaccgccgcctttttagtcacttaaacgcttaaacggcttttaccgcatccgcgatacgatgggcgaaagccgtaacctgcgcttcatcctcgccttcaaccatcacgcgaatcagcggttcggtaccggatttacgtagcagtacccgcccacgattgccgagcgtggcttctacgtccgccgttaccgctttcaccgcttcattttccagcggatcgccgctaccagcggtgtaacgcacgttaaccagaatctgcgggaacattttcattccgctgcacagatcgtgcagactcatatgattacgcaccatcgccgccagaacttgtagccccgccacaataccgtcgccagtggtcgttttatccagcagaataacgtgaccagagttttccgcgccgatgcgccagcctttttcctgcaatttttccagcacatagcggtcgcccactttcgcccgggcaaacggaatgccaagctgcttgagcgccagctccagccccatattgctcatcagcgtccccaccgcgccgccgcgcagttgcccctggcgcagcccttcgcgcgcgatgatatacatgatctgatcgccatcgactttattgccttcatggtcaaccatgatgacccggtcgccgtcgccgtcaagcgcgatgccgaggtccgccttctccgccaacacgcgcgcctgcaacgcgcgcacgtcggtcgcgcccacttcttcattaatgttgacgccgtttggctcacagccgatggcgatcacggtcgcgcccagctcgcgcagcacattcggagcgatgtggtaggtagcgccgttggcgcaatccacaaccactttcaggccgttgaggctcagttcgttcgggaaggtgcctttacagaactcaatatagcgtccggcggcgtcgacgatgcggctggctttccccagctcggcggagtctacgcaggtgatctctttttccatttcggcttcgatggcttcttccacatcgtcaggcagtttcgtaccgtcgatagagaagaatttaatgccgttatcatagaacgggttatgggaagccgagataacgatacccgcctccgcgcggaaagtccgcgtcagataggcgacggctggcgttggcataggtccggtaaacgaggccgacagccccgcagcggcaaggcctgcctccagcgcggattccagcatatagccggaaatacgcgtatctttaccgataatgattttacgcgaaccatgacgcgccagcacttttccggcagcccaacccagtttaagcacgaaatcaggtgtaatgggggcattgcctacacgtccgcgaatcccatcggtaccgaaatatttacgattactcatagcgtttgtttccctttgcagacagagtggcttccaccacccgcatcgcctctacggtttctttgacgtcatggacgcgaatgatctgcgcgccctgcatcgcagcaattaccgcgcacgcaaggctaccgttcagacggtctgatggtcccacgttaagtaactgaccaaccatcgttttacgtgacatgcccaccagcagcggcaggttaaaatgatgaaactcacccagtcgcgccagtaaggtataattgtgagagagatttttaccgaaaccgaatcctgggtcgagcaacaatttctcttttgcgatgccggccttctcacaacgtgctatttgctcaataaagtagcgattcacctcggcaaagacatcgtcatatttcggcgcctcctgcatggttttggggttgccctgcatgtgcataagactgaccggcaagccggtttccgctgccgcttccaacgcgccgggttcggagagtgaacggacatcattgataatatgcgcgcccgcccttgccgcttcacggatcacctcgggtttagaggtatccacagaaatccacacttcaaaacgttgcgcgattgcttccagtaccggaataacgcgatccagctcttcttccacgctcacttctgccgcgcctggtcgcgttgattccccccccacatcaataattgtcgccccggtattcaccattaaattcgcatgtttcaccgcctcaatcagcgtgttatgcgcgccgccgtcggagaacgaatccggcgttacgttcaggatccccataacatgcggatgagtgagatcgagcgtggcgccctgagcgaagagtttcatggtcaaaatccctgttttatttatggtgagttaaaaaaagaaaaaccccggggcaagccccagggtttcggtgagcgctaaacataatgttgtaaaacaaatgcttatttgtcgcccagctgctctgacatcgtgttgcccgggttcggcgtgcgtggttcatcaaccggacgcggcgcctgaggcgtaccattgctgtcagagttattggtgccgtttggatcttcccagcccgcaggcggacgcacttcacgacgcgccatcaggtcatcaatctgcggcgcatcgatggtttcatatttcatcagcgcatctttcatcgcgtgcagaatatccatattgtcagtcaggatctgacgagcgcgattgtagttacgttcaatcagcgctttcacttcctggtcgatgatacgcgcagtttcatcagacatatgtttcgcttttgcgacgctacggccgaggaacacttcgccctcttcttccgcgtacagcaacggaccgagtttctccgagaagccccactgggtgaccatgttacgcgccaggttagtcgcgactttaatgtcgttcgacgcgccggtagaaacatgctcaacgccgtagataatctcttccgccagacggccgccgtacagcgtgctgatttggctttccagcttctgacggctggcgctgatcgcgtcgccttcaggcaagaagaaggtcacgcccagcgcacgaccacgcgggataatcgtcactttgtgcaccggatcgtgttccggcaccaggcgaccgataatcgcgtggcccgcttcgtggtacgcggtcgactctttctgcgcttccgtcatcaccatggagcgacgttcggcgcccatcatgattttgtctttcgctttctcgaactcaaccatcgacactacgcgcttgttgccgcgtgcggcaaacagcgccgcttcgttgaccaggttcgccaggtccgcaccggagaagcccggcgtaccgcgcgcaatgatcgccgcatcaatgtccgtcgctaacggtacgcgacgcatatgcaccttcagaatctgctcacgaccgcgaacatccggcaggcctaccaccacctgacggtcaaaacggccaggacgcagcagcgccgggtcaaggacgtccggacggttagttgcggcgataacgatgataccttcgttaccttcgaagccgtccatctcaaccagcatctggttcaacgtctgctcacgttcatcgtgaccaccgcccagaccagcgccacgctggcgacctacggcgtcgatttcatcgatgaagataatgcacggtgccgctttcttggcttgttcgaacatgtcacgcacacgagatgcgccgacacccacgaacatttccacaaagtcagaaccggaaatcgtaaagaatggcaccttcgcttcacccgcaatggcttttgccagcagggttttaccggtacccggcgggccgaccatcaggacgcctttcggaattttaccgcccagcttctggaaacggctcggttcacgcaggtattcaaccagttccgccacttcttctttcgcttcgtcacaacccgcaacgtcagcaaacgtggttttgatctgatcttccgtcagcatacacgccttgctcttaccgaacgacatggcgcctttgccaccgccgccctgcatctgacgcatgaagaagatccagacgccgatcagcaacagcatcgggaaccaggagatgaagatagaagccagcaggcttggctcttcaggtggttcgccaacaaccttgacgtttttagtcagcaggttatcaagcagcttcggatcattaatcggaatgtaagtcgtgtaacggttactatctttcttggtaacgttgatctcacgtccgttgatacgcgcttcgcgaacctggtcctgattgacctcttgcaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagtttctttcaaaccttacgtctgaaatctgccggttatcactttcgcccggtcgctacaatgtacacttcacgcgaacgcgcgcgcgaagagtccggcttacgaactttaaccttcgtaaacagggagcgaatttcccttagatactcatcgaaaccttcgccctggaacaccttcactacaaaacttccgcctggcgccagcacatcgcggcacatatctaacgccagctccaccagatacatggcgcgggggatatccaccgccggtgttccgctcatgtttggtgccatatccgacatgacaacttgtactttactgtcacccacgcgttccagtaacgctttcatgacaagttcatcacgaaaatcgccctgaagaaagtccacaccaacgataggatccataggtaaaagatcacaagcgatgatgcggcctttgccgccaatctgcgtgaccacatactgtgaccaccctcctggcgcagcgccgagatcgactaccgtcattcccggcttaaaaagtttgtcactttgctgtatttcatcaagtttaaaccaggcacgggagcgtagcccctttttctgcgcctgttgaacatatttatcgctaaagtgttcctgaagccagcggcttgagctggcagaacgctttttacctgtcatttaactttcccgtcggggcagttcatcgtagccaatggcgtaaatttctacacgcctatttggcgatataagggagatggcggtagaatgacccgttttcaatcccaacgtaagcaaaaatatacgatgaatctgagtactaaacaaaaacagcacctaaaaggtctggcacatccgctcaagcctgttgttatgcttggcaataatggtttgaccgaaggggtactggccgagattgaacaagcgttagagcaccatgaacttatcaaggtgaaaatcgcctcggaagatcgcgaaacaaaaaccttgatcgtggacgctatcgtgcgcgaaaccggcgcctgtaacgtacaggtcatcggtaaaacgctggtgctgtatcgcccaactaaagagcgtaaaatctcgctgccgcgttaaggatatcctaaagtcgaacacaaaatctgtgtaaaacgaggggttttccacgagcaggagagcaaaatgccacgctctctccgttgataaaaggccgctatgcggcctttttcctttctttacaatacaccaacaatttgcgtattgagtactgcttaaaggtattccactttaagcacttcgtattccacatcgccgccaggcgttttgatcaccacgacgtcatcctgctctttgccaatcaggccgcgagcgattggcgagtttaccgaaatgagattttgcttaaaatccgcctcatcatcgccaacaatacgataggtctgctcttcgtcggtgtccaggttcagcaccgtgacggtagcgccgaaaatcacgcgaccattgttcggcattttggtgacgtcaatcacctgcgcattcgacagttttgcttcgatatctttaatgcgcccttcgcagaaaccctgctgttcgcgtgcagcatgatactccgcgttttcttttaaatcgccatgttcgcgcgcttcggcgatagcggcgatgatttcaggacggcgcacagatttcagaaaatccagctcttcgcgcagtttttcggctccgcgtaaggtcatcggaatagcttgcatttgttatacctcttgaacattcctgtagggggcaatgaactctaccccggctgctaagccagccccggcatatgccataccagggtcagaagcaaaaaaacaccaacccgggcgcgcagtcccaggtcagctacaatttcctctttgataaccattttaccctggagttccctatgggtcatcgtttactttttagggcgttgcgccgtagtatgacggcttgtttccagggtgttagcgcgagattatgcgattttccagatttatcatcggattgaccaccagtatagcgttcagcgttcaggccgcgaatattgacgaatacatcaaacagcttccggccggcgccaacctcgcgctgatggtgcaaaagattggcgcgcccgcgccggctattgattatcatagtcagcagatggcgcttcccgccagtacccaaaaggtgattaccgcgctggcggcgctgattcaactcggcccggatttccgttttacgaccacgctggagactaaaggcaacgtcgataacggcatcctgaaaggtgacttaattgcgcgattcggtggcgatccaacgctaagacgtcaggatattcgcaatatggtcgcgacgctgaaaaagtcaggcgtcacgcaaatcgacggcaatgtgcttatcgacacgtcgattttcgccagccacgataaagcgccaggctggccgtggaacgacctgacgcagtgtttcagcgcgcctcccgccgccgccattgttgaccgcaactgtttttctgtgtcgctttatagcgcgcaaaaaccaaacgatttagcttttattcgcgtggcctcttattatccggtaacgatgttcagccaggtacggactctgccgcgcggttcggcagacgcgcagtattgcgagctggatgttgtgcctggcgatttgaaccgttatacgcttaccggctgtttaccacagcgcgccgacccgctgccgctggcctttgctattcaggacggcgccagctacgcgggcgcgatcctcaagcaggaactgaaagaggccgggataacttaccgcggcacgctgctgcgccagacgcaggttaacgagcccggaacgatcgtcgccagtaaacagtcggcgccactgcacgatctgcttaagattatgctgaaaaagtcagacaacatgatcgccgatactgtttttcggatgattggtcatgtcaggtttaacgtgcctggcacctggcgggcgggatcggatgctgttcgccagatcctgcgccaacaggcgggaattgatatcggcaataccattattgccgacggttccggtctttctcgccataacctgatcgctcccgccacgatgatgcaggtgctgcaatatatcgcccaacacgataacgagctgaactttatctctatgctgccgctggcgggctatgacggttcattgcaataccgcgccggcctacatcaggcgggcgtagacggtaaggtttcggcgaaaaccgggtcactgcagggcgtgtacaacctggcgggctttattaccaccgcaagcgggcagcggatggcatttgtacagtatttgtccggctacgcggttccacctgccgatcagcgtaatcgacgtattccgctggtacgcttcgagagtcgattgtacaaggatatttatcagaataactgagtgcattattgccggatggcggcgctaacgcgtcttatccggcctacaaagaacataataaaacgggccgcaaatgcggcccgttggcttttgtaggccggataagcgtaagcgccatccggctacgagattaacgtttgtagatgaactcgacgccttcttcgtcgtcttcatcccagtcgtcatcccagtcatcgtctgcgtcttcttccacttcagccaactgctggcgatgataatcgtcccacatgaactcgactttttccggctgttttgcttcttcagcctgcgcgatcggattctcgatgataaaggtcatcacatcccagcagagatctttcacccctagctgactggcagcggaaatcagatagtatttcccttcccagcccaacgcttcggcgatcgctttcgctttctcttccgcttcggatttatccatcagatcgatcttgttgaacactaaccagcgcggtttagccgccagatcctggctgtatttttccagttcgccaataatgatacgggcgttttccaccggatcggaaccatcgatcggatcgatatcaatgaggtgcagcagtacgcggcaacgttcgaggtgcttcaagaagcgaatccccaggcccgcgccttccgccgcgccttcgatcaaccccggaatgtcggccaccacaaaactcttttcgctgtccatacgtaccacgcccaggctcggcaccagcgtggtaaacggatagtccgcgactttcggttttgctgccgataccgcgcgaatgaacgttgatttaccggcatttggcatccccagcatcccgacatccgccagcagcatcagttccagcagcaggtcgcgcttatcgcccggcgtaccattggttttctggcgcggcgtacggttaaccgaggatttaaaacgggtattgcctaacccatgccagccgcccttcgcgaccaacagacgctgaccgtgtttggtcatgtcgcccatcgtttcaccggttccttggtcgataacgcgcgtaccgaccggcactttgatggtcacgtctttaccgcgtttaccggtacagtcgcggctcgcgccattctgaccacgttcagcgcggaacgatttttcaaagcggtaatcgatcagcgtattcaggttttcatcggcttccatccagacgtcgccgccgtcgccgccatcaccgccgtccgggccgcctttcgggatatatttttcgcggcggaagctcacacagccattaccgccatcgcctgcaacgaccagaatcgatgcttcatcaacaaacttcattttattctccgtaaatcattcgcctgagcggggttgcgaaaccaccgtttcatgcttgcgtaaaccgccccaaatacgatgaccaatggcggaatacatcgcgcccgcaaccacgacaaacgcaccgagataacctaaaaggtttaacatcggtctggcgaagaaatcgggccaggccatagataaaagatctgaaaacagcagggtaaatagcggtgtaagcgtgattatcgcgctcacctgcgccgcctgccaacgcgccatcgcttccgccagggcgccatatcctaccagcgtatttagcccgcagaaaatcaaacaggcgagctgccagtcgctcagttgcgctatcaccatcggttttgccaacggcaaaagcgctatcgtacataaagtgtacagtaaaaacaggatctgctgcgaggccagacgtcgcaataatactttttgcgccacgccatagctcacccacaccatcgccgcgcctacgccaaaaataacgccccaggtgtagtcggtcagtcgggtaaaaatctcgatcagactggtgttaaaaaacattaccagcccgctcaataacatcagcgcgccaatcacctgcgtaccgcgcatcttttctttcagaataaagacgctggcgaccatcatgccaaccggcgagagctggccgataacctgcgacgcggttgggcttaaatattgcagggaagaactgaacaaaatgaaattaccgaacagtccgcaggtcgctatcgccaataacaccaaccagcgcggcttacgaaaaatacgcagcggcggcagctttctttttactgccagtatcgccccgaggccaatactggccattaagaagcggtagaagacaatggttgaaggctccatcacctccagcacttgcttcattgctattggcaacgctccccagcacatcgcggtagtgagcgctaaaagaatgccaatgcctgcctgctgcttcatgccgtgttccctgcaaagacccgttaacggcattcacacagccacacggatatattttagtcggccatcgaatgtaaaaagccccgcaacaggtgcggggctttcatccgttaccggaccacaaaaaacttactcagcaacgatgctgatgtatttacggtttttcgggcctttaacttcgaatttcactttaccgtctgctttagcaaacagagtgtggtcacgaccgcaaccaacgttggtgccagcgtggaatttagtaccacgttgacgaacgatgatgctgcctgccagaactgcttcaccgccaaagcgttttacgcccagacgtttagcttcagaatcgcgaccgttacgagtcgagccgccagcctttttatgtgccatttaatctgctcccctaatcttaagcgctgatgccggtaattttcacatcagtgaaccactgacgatggccctgctgcttacggtagtgtttacggcgacgaaacttaacgattttaactttctcgccacgaccgtgggcaacaacttcagctttgattacgccgccatcaacgaaaggaacgccgattttgacttcttcaccgtttgcgatcatcagaacttcagcgaactcgatagtttcgccagttgcgatgtccagcttttccaggcgaacggtctgaccttcgcttactcggtgttgtttaccaccactttggaaaaccgcgtacataaaaaactccgcttccgcgcacacctttcaatgattcagagcgcgctataaatattcacaatagggcgcgaatattacgcaaattgcacggctttgacaagtgctaccatcaatacatgaagaaaaaaaaacacaacgcatacggtaacgtttatctgcggcgttttttcagtacaatcagggtatatttctaaccataaaccctacgttacctcattcagacatgggataatcggagcgataagcccggcttttgcgatgaatttagaaaaaatcaacgagttaaccgcgcaagatatggcgggtgtcaatgcgacaatccttgaacagcttaattccgacgttcaactgattaatcagctaggatattacattattagcggcggcggaaaacgcattcgtccgatgattgccgttcttgccgcgcgtgcggtgggttatcagggtaacgcgcacgtgactatcgccgctctgatcgagtttatccacacggcgacgctgctacatgatgatgtggtggatgaatctgatatgcgtcgcggcaaagcgacggcaaatgccgctttcggtaatgccgccagcgtgttggtcggcgactttatctatacccgcgccttccagatgatgaccagcctcggctcgttaaaagtgctggaagtgatgtcggaagcggtcaatgtgattgcagaaggcgaagtgctgcaattgatgaacgtgaatgacccggacattaccgaagaaaattacatgcgggtgatttacagtaaaacggcccgtctgttcgaagccgccgcccagtgctccggtattcttgccggttgtacgcctgagcaagagaaagggttgcaggactatggccgctaccttggtacggctttccagctcattgacgatctgctggattacagtgccgacggcgagcatctcggtaaaaatgtgggtgatgacctcaatgagggcaaacctaccttaccgttgcttcacgccatgcgccacggtacgccagaacagtcagcgatgatccgtaccgctattgaacaaggtaatggccgtcatcttctggaaccggttctggaagcgatgaccacctgcggctcgctggaatggacgcgtcagcgagcggaagaagaagccgacaaagcgatatccgcgttgcagatattgccggataccccatggcgtgaggcgctaatcggtctcgcacacatcgcggtgcagcgcgatcgttgatgccattctcttatcccgcgcactgcgcgggatatcccattaagttctaataaactccagataccctattgcctgtcttttcgtatattcatatacggcttcccctggcatattctgaatattgccgccacttacatgaactttttagaacattccttcacgaagcgttatagtatcgaacgtcgtcgggttgttaaaaccgtaagtgattaatctaaggagtgatggatgtatggaaagcaagcttattgactggcatccggccgatatcattgccggactacgtaaaaaagggacttcaatggccgctgagtcacgccggaatggattgagttcatccacgctggccaatgcattaacgcgcccgtggccgaaaggagagttgattatcgcgaaagcattgggaacggaaccctgggttatttggccatcgcgttatcacgatccgcgcacgcatgagtttatcgacagaacgcggcttatgagagcgcgtaataaagacaaacagaatgtagagtaagtgcctgtaaaacaacccccgcaatcgcgttcgcgggggttattcagcgtacagaaggttattcgcctttcacgcgttcaatattcgcgcctagcgcgcgcagtttgtcttcgatgcgctcataaccgcgatcgatgtgataaatgcgatccacaatcgtcgtgccttccgcaatacagcccgccagcaccaggctcgcagatgcccgcagatctgtcgccatgacctgggcgccagagagcgtttctacgccatggcatatgacggtattgctttcaatttccgcacgcgcgcccatgcggctgagttcaggcacgtgcataaaacggttttcaaagacggtttcagtgataaagcccgtcccttccgccaccaggttcagcaacgtgaactgcgcctgcatatcggtcgggaatgccgggtgcggcgctgtacggacattgaccgctttcggtcgtttgccgtgcatgtccagactaatccagtcctcgcccacttcgatatccgcgccagcatcgcgcagtttcgccagtaccgcgtccagagtgtccggttgcgcgttacggcagaggattttgccgcgagagatcgctgccgccaccaggaaagtccccgtttcgatacgatccggcagcacacgataaacgccgccgcccagacgctctacgccctcgatcgtaatacgatcggtgccctgcccggcgatcttcgcccccagcgtaactaggaagttagcggtgtcgacaatttccggctcgcgcgcggcgttttcaatgatggtcgtcccttccgccagcgtagcggcgcacataatggtgacggtcgcgccgacgctgaccttatccatcacgatatgcgcccctttaagacgtccttcgacggaggcctttacgtagccctcttctagcttgatggtcgcacccagttgttccagaccggtaatatgtagatcaaccggacgcgcgccgatagtacagccccccggcagagagacttgtccctgaccaaaacgggcaaccagcggccccagcgcccatatcgaggcgcgcatggtcttaaccagatcataaggcgcgcagaacacgttcacctggctggcgtcaatgtgtaccgatccattgcgttccactttcgcgcctaattggctcaggagcttcatcgacgtatccacgtctttcagttttggaacgttttggatctctaccggttcttctgccagcagagcggcgaacaggatcggcagcgcggcgtttttggcgccggaaattgtgacttcgccctggagcgtcgttggcccctgtacacgaaatttatccattattgtattctcagttaagcattcatctccgctaccggcaggttacccgtagcttaaaatccgttaagtttacgatcgcgcgcccattccgccggggtatatgctttgatcgatacggcatggatacggttgtccgcaatgtactccattagcggcccatagaccgtttgctgtttcttgacccggctcatgccgtcaaacatctcgcccacggcaataacctgaaagtgactgccatcgccggagacgtggacttcctggagggagagggcattcatcagcacactctgaatttcatgattttccatgggttctttattcgtcaaatagtgaaaacagcccaacatcttagagcaaagtcgcgccgtcttaaataagcaaaagattacgctgataaatcagcgcggtaaaagtgccggatggtgctgctaacgcaatttatccggcctacggggatcatgcgaagtgtaggccggataaaccatccggcattcattacatacggggaagtacgtcttcaggcaagttatataattgcgccagcgcgtaaaccttgtcgttaacgccagacagcgacacggcattgccctgcttttttgcctggttcacaaggtgcgccagcagcgccagtccccccgtatctaccctggagatctggctcaggtcgatacgggtaacgccattcatcgcttctacgcgcgcgtcccatagcggcgccaacacgtcctgatccagctctcccgccagcaccagagtgtccgcctcacgcgtccaggtgagttgcggcgtcattactgtttctcgtccaaagtaattttctgttgagagatagatttcagttgtgcggtcaggccgtcgatgcctttagtacgcagcagatcgctccactcattttgcttggtggtgatcatgctgacgccttccgcaatcatgtcatacgcctgccagttgccggtctgagtgtttttgcgccactggaaatccaggcgtaccggcggacgaccgttgggatcgataatcgttacacggataggcacaatggtcgcatcgcccagcggttgctcaggcgctatctggtaagtctggccgtggtacatcgccagcgcctgaccgtatgcctgtttcaggtattcgcgaaacgctgcaaaataggcttcacgctgcgccggggtcgcctctttgtagtagcggcccaacaccagcgcgccggcatattttacctgcacgtacggcagaagttcctgatcaacaacgtctcgcaggtaatccggattggcacgaattttcggctgttcgtttttcaggcgatcaaaagttttctgcgccgcctcgttcatcagtttataaggattgctctgatccgctgccgttgctgcgcttaatggcgcaatgaccagcagggccaccatcatcagtcgtttaaacatgcctcaattctcctgagattatttcgtttcgcccgcgggcgttgtggcttcagtatggccttccgttgcggctggcgcatcgccagaattcttattgtcgtcgcctttgctgttataaaggaactggccaatcatatcttccagcaccattgcagacttggtgtcctgaatcgtactcccatctttgaggatagacgttcccagctcaggatcttcaaaaccgacgtttaatgccagatattgctcccccagcagcccggaagtacgaatactcaacgagctggtatcgggaatatggttataacgctcttcgatgtcgagcgttacgcgcggcaggtatgttttcggatcaagcgagatatcttcaacccgcccgacaaccaccccgccgatgcgtaccggggaacgcactttcagaccgccgatgttatcgaaggtcgcataaaccttataggtcggctccgtgcgcatagaggtcacatttgccgccttcaggcaaacaaacagcgccgccagcaacgctaccagcaaaaaaacgcctacccaaatttcattttttttcgtttgcatgaactcaattcccaaacatcagtgcggtcagcacaaaatccagccccagaacggccaacgatgcgtgaaccacggtacgcgtcgttgcccggctaatcccggcagaagtcggtattgcgtcataaccgttgaataacgcaatccatgttaccgtaatggcgaacaccacgctctttatcagacagttcaccaggtccatacgccagtcgacggcattctgcatcgcggaccagaagaacccggcgtcgattcccttccagcttacgccgaccagcgagccgccccagataccgaccgccacaaagataatggtcagtagcggcaatgaaatcacgcccgcccaaaagcgcggcgaaatcacccggcgcaatggatcgaccgccatcatctccatactggagagctgctccgtcgcccgcatcaggccgatttccgccgtcaacgccgacccggcccgcccggcaaacagcaacgccgcgaccaccggccccagctcgcgcagcagcgaaagcgccactaacatgccaagactggtctccgcgctgtaagtggtcagaaccagatagccttgcagccccagcaccataccgatgaatacgccggagacaataatgataagcatcgacaagacgcccacattataaagctggcgcaccagcagcggcgcatgtttgcgaaactccggcttaccgataatcgcattgaataacattaacccggcgcgcccgaacgtcctgacggttttgatcccgctgtgtccgagtgctgccagcgcatttaacagcatgagtggcttaactccctgtttcgagtaaatcaaggtgatagtcgcccgccggatagcggaacggaaccggcccgtcggcaataccgtcaaggaactgacgcacgcgcgggtccgtattctcctgcaacgcctgagcgctaccgtgagcgacgatttttttgtccgccatgatccaggcgtgatccgcaatactgagcacctctggcacatcatgcgagaccaccacgcaggtcacgcccagcgcgctgttcaattctgaaatcagcttcaccagaacgcccatggtaatcgggtcctggccaacaaacggctcatcgaacatgatgagatccggttccagagcgatggcgcgcgccaacgcggcgcggcgcgccatcccaccggagagctcggaaggcatcagttttgccgcgccgcgcagcccgacagcttccagtttcatcatcacgacgctttttagcagcggcgcgggtaaattggtgtgctcccgtagcggataggccacattgtcaaacacgttcatgtcggtaaacagcgctcccgactgaaacagcatactcatacgtttacggacggtgtagagccgcgaacgggacatggccggcacattctcgccatcaaataagatctcgcccttatccggcgggatctgtccgccaatcaggcgcaacagcgtggttttaccgatgcccgacggccccatgatcgccgtgatcttcccgcgcggcaccgtcagggaaatattatcgaaaatgcagcgttcgccacggcaaaagctgacgtcgcgcatatcgactaaattggccgcagactgacccattgattcatccttcgtattgccttgttgaggtaaccatggcgctgaatttaaccatgggttcgacataattacagaatattaactgacagggttagcgaaagctggcattcgttttactttttagccgcataaagtcaaaattaggacttcgttacggcttccagatatcccttccaggggaccggcgagtatacctgaagaaaggactttagatgcttttagcgatggcgctactcataattggtttgcttctggtggcctacggcgccgatcgtctggtgtttgcggcctctattttatgccgtacattcggtattcccccgctgatcatcgggatgacggtcgtgagtatcggcacctcgctgccggaaattattgtgtcggtcgccgcatcgctacacggtcagctcgatttggccgtcggcgcggcgctcggttctaacatcaccaatattttgctgatcttagggctggcggcgctggttcgtccatttaccgtgcattccgatgttctacgtcgcgaattgccattaatgttatttgttagcgtggtagccggttccgtactgcatgacggacagttaagtcgcagtgatggtatctttctcctgcttctggctgtgctatggctgttattcattgttaaaatcgcgcgtctggccgaacgccaggggaatgacagcctcacccgcgaacaactggcggagctgccgcgcgaagacgggctccccgtcgcgttcttatggctgggcattgcgctggtcatcatgccgatggcgacgcgcatggtaatcgataacgctacggtgctggcgaactatttcgccatgagtgaattaacgctcggtctgacagtcatcgccgtcggcaccagtctgccagaactggcgacggcgattgccggcgtgcgaaaaggcgaaaatgatattgccgttggtaatctcattggcgccaatatttttaatctcgccatcgtgctgggactgcctgcgctgatcgcgccgggggagatcaacccgctggcgtttgggcgtgattatagcgtgatgttgctggttagcgtggttttcgctttactttgctggcggcatccgcgccagattggccggggcgcaggtatactgctgaccggcgggtttatcgtatggctggcgatgctctattggctatcgccacttcttgttggataactggaaacggattatgtcgcatttagcgttgcaaccggggtttgactttcagcaggcaggcaaagaggtcctggaaattgaacgtgaaggcctggcggagcttgatcaatatatcaaccagcatttcacgctggcctgtgaaaaaatgttcaactgcaccggaaaagtggtggtcatggggatggggaaatccggccatatcggacggaaaatggccgccacgttcgccagtaccggcacctcttccttttttgtacatccaggcgaagccgcgcacggcgatttggggatggttacgccgcaggatgtggttatcgctatctccaactccggcgaatccagcgagatcgcggcgctaataccggtgcttaaacggctgcacgtaccgttaatttgcattaccgggcgaccggaaagcagcatggcgcgtgcggcagatgtgcatctatgtgttaaagtgcccaaagaagcgtgtccgttaggcctggcgcctaccagtagtaccaccgcaacgctggtgatgggcgacgcgctcgccgtggcgttgttaaaagcgcgcggctttaccgccgaggatttcgctctgtcgcatcctggcggcgcgctgggacgtaagctactgctgcgcgtaagcgatattatgcatactggcgatgagatcccgcatgttaataaacatgccaccctgcgtgatgcgctgttagaaattacgcgtaaaaatctcggtatgaccgtcatttgcgatgaatccatgaagatcgacggtatcttcaccgacggcgatttacgtcgcatgttcgatatgggcggcgatatgcgccagttggggatcgccgaggtgatgacgccagggggcattcgcgtgcgtcccggtattctcgctgtcgatgcgctgaatttaatgcagtcccgccatatcacctccgtactggttgctgatggcgaccagttactcggtgtgttacatatgcatgatctcctgcgtgcaggcgtcgtgtagaaactcaaggataattaacgatgagtaaagcaggtgcgtcgcttgcgacctgttatggccccgtcagcacccatgtcatgaccaaagcggagaatatccgcctgctcatcctggacgtggatggcgtattgtctgacggcctgatttatatgggcaataacggcgaagagctgaaggctttcaacgttcgtgacggctatggtattcgctgtgctttgacctccaatatcgaggttgccattattaccggacgaaaggctaaacttgtagaagatcgctgcgccacgctggggattgtccatctttatcagggacagtcgaataagctgatcgcctttagcgatctgctggaaaaactggccattgcgccggaaaatgttgcctatgtcggcgatgatctgattgactggccagtgatggaaaaagtggggttaagcgttgccgttgcggatgcgcatccgctgctgatcccccgcgctgactatgtgacgcacattgccggcgggcgcggcgcggtacgtgaggtgtgcgatttgctgctgctggcgcagggcaagctggatgaggccaaagggcaatcgatatgagtaaaaccagacgttgggttatcattctactgtcgctggctattctggtactgattggtattaatctggcggataaagacgatcctgctgccgtgatggtcaacagcaacgatcccacgtataaaagcgagcacacggataccgtcgtgtacagtccggaaggcgcgttgagctatcgtctgatcgcgcagcacgttgaatatttttccgatcaggcggtctcatggtttacgcaaccggtattaaccacctttgataaggataaagtgccgacatggtcgatcaaggccgataaagccaaattgactaacgatcggatgctctatctgtatggccatgttgaagtcaacgccctggtgcctgacgctcaattacgcagaattaccaccgataacgcgcagattaatctggtgacgcaggatgttacctcgaacgatctggtgacgttatacggcacaacatttaactccagcggactgaaaatgcgcggtaacttacgcagcaagaacgccgagctgattgaaaaggttagaacctcttatgaaattcaaaacaaacaaactcagccttaatcttatgcttgccggctcgctgctggccgccagcattccggccttcgccgtcacgggcgataccgaacagcctattcatattgactcggatcaacagtcactggatatgcaaggcaacgtcgtgacctttacgggcaacgtggtaatgacccagggcacgattaagatcaacgccgataaagtcgtggttacccgccctggcggcgaacaggggaaagaggtgatcgacggttacggcaatccggccaccttctaccagatgcaggacaacggtaagccggtgaaaggccacgcttcccatatgcattacgagctggcgaaagattttgtggtgctgaccggcaacgcttatctggagcagcttgacagcaacattaccggcgacaaaatcacctacctggtgaaagagcagaaaatgcaggccttcagcgagaaaggcaaacgcgtcaccaccgttctggtgccgtcgcagttgcaagacaaaaacaaaggccagactccggcgcaaaagaagagtaactaattcgttatggcaacattaactgcaaagaatctggcgaaggcctataaaggccgtcgcgtagtggaagatgtcagtctgaccgttaactccggggagattgtcgggctgctcggtccaaacggcgcgggtaaaaccaccaccttttatatggtcgtcggtatcgtgccgcgtgacgcgggcaatatcatcatcgatgatgaagatatcagtctgctgccgctgcacgcgcgcgcgcgccgcggtatcggctatttgccgcaggaagcctctattttccgccgtctcagcgtatttgataacctgatggcggtactgcaaattcgtgacgatttgaccgcagaacagcgagaagaccgcgccaacgagctgatggaagagtttcatatcgagcatctgcgcgacagcatgggacaggcgctgtccggtggtgaacgccgtcgtgtagaaatagcccgcgcgttggccgctaatcccaaatttatcctgctggatgaaccctttgccggcgtcgacccgatttccgttatcgacataaaacgcattatcgagcatctgcgcgatagtgggctcggcgtgctgatcaccgaccataacgtccgtgagacgctggcagtctgtgaacgtgcctatatcgtgagccagggccaccttattgcccacggtacgccgacagaaatcctgcaagacgaacacgttaagcgtgtatatcttggggaagacttcagactctgatagggtagagggctatgctgctctagcgggagaaaacgactctgaatatgaagcaaggtttgcaactcaggcttagccaacaactggcgatgacgcctcagctacaacaggccatccgtctgttgcagttgtctacgctggaacttcagcaggaactccagcaagcgctggaaaataacccgctgcttgagcaaaccgatcttcatgacgaaatcgacactcagcaacctcaggatgacgatcctctcgataccgccgacgcgctcgaacaaaaagagatgccggaagagctgccgcttgacgccagttgggatgaaatttacaccgccgggacgccgtccggccccagcggcgattatatcgacgatgagctgcccgtctatcagggcgaaacgacgcagtcgttgcaggattatctgatgtggcaggttgagctaacgcccttctcggacaccgatcgcgctattgcgacatccattgtcgacgcggtagatgataccggctatctcaccgtatccctggacgaaattcgcgaaagcatgggcgatgtagaggtggatctcgatgaggtcgaagccgtcctgaagcgtattcagcgttttgatccggtaggcgtcgcggcaaaagatcttcgcgactgtctgctgatccagctttcacaattcgacaaatccacgccgtggctggaagaggcgcggcttattatctgcgatcaccttgatctgctggccaaccacgatttccgcacgttgatgcgcgttacccgactaaaagaagaggtgctgaaagaggcggtaaacctgattcagtcgctcgatcccagacccggtcaatcgatccagaccggcgagccggagtacgttatcccggatgtgctggtacgcaagcataacggtcgctggacggtggagcttaatagcgacagtattccccgtttacagattaaccagcactatgccgccatgtgcaatagcgcgcgcaacgatgccgacagccagttcatccgcagtaatttacaggatgcgaaatggctgataaaaagccttgaaagccgtaacgacacgctgctgcgcgtcagtcgctgcatcgtcgagcaacagcaagccttttttgaacagggcgaagaatatatgaaaccgatggtactggcggatatcgcccaggccgtcgagatgcacgaatccactatatcccgcgtgaccacgcagaagtatttgcacagcccgcgcggtatttttgaactcaaatatttcttttccagccacgtcaataccgaaggcggaggcgaagcctcttccaccgcgattcgcgcgctggtgaagaagttaattgcggcggaaaaccccgcgaaaccactgagcgacagcaagttaacctctctgctgtcagaacaaggtatcatggtggcacgccgcactgttgcgaagtaccgagagtctttatccattccgccgtcaaaccaacgcaaacagctggtttgacccaaccgataaggaagacactatgcagctcaatatcaccggacataacgtcgaaattactgaagccctgcgtgaatttgtgacgacgaaattcgccaaacttgaacagtattttgagcggattaatcaggtatacgtggtgttgaaagtggagaaggtcacgcacatctcggatgcgacgctacacgttaacggcggcgaaattcacgccagcgcggaaggccaggatatgtatgccgccattgacggcttgattgataaactggcaaggcagttaaccaagcataaagataaactgaaacaatactaattgtccgggcagttagccagtgcaggacggcctgttgtgtgacacaacgggccatttgtacagttagcgctccgaacctggccatcaacctgacaggacaggttcttaggtgaaattatgataaataacgatacgactctacaactgagcagtgtacttaaccaggagtgtacgcgtagcggcgttcattgtcagagtaagaaacgcgcgctggaaatcatcagcgaactggcggcaaaacagctcagtttacctcctcaggtcgtgtttgaagccattctgacacgcgaaaaaatgggcagtaccggtattggtaatggtatcgccatcccgcacgggaaactggaagaagataccttacgcgccgtcggcgtgttcgttcagctcgaaacgccgatcgcgttcgacgccatcgataaccagccggtcgatctcctcttcgctctgctggtgcccgccgatcaaactaaaacgcatctgcacacgctgtcgctggtggcgaaacgtctggcggataaaacgatctgccgccgcctgcgcgcggcgctgaatgatgaagagctgtatcaaatcattactgacaccgaaggtgagcagaatgaggcataacaactcaatggcatttatttctgtcgttgtgaggagaaacggtacatggtactgatgatcgtcagcgggcgttccggatcaggtaaatctgtcgctctgcgcgcgctggaagatatgggattttactgcgtggataacctccccgtcgtgctgttgcccgatctggcgcgaacgctggccgatcgccagatttccgccgccgtcagcattgatgtgcgcaatatacctgaatcacctgagatttttgaacaggcgatgaataatctgcctggcgctttctcgccgcaattgctgtttcttgatgccgaccgcaataccttgattcgccgctacagcgacacgcgccgtttgcatccgctttccagcaaaaatctttctttggagagtgcgatcgataaagagagtgacttgctggagccgttacgctcacgtgcggatctgatcgtcgacacttcagaaatgtccgtccatgagctggcggagatgctgcgtacccggctattgggcaaacgcgagcgcgaactgacgatggtatttgagtccttcggctttaaacatggtatcccgattgatgcggactatgtgtttgatgtccgctttctgcccaacccacactgggacccaaaactgcgccccatgaccgggcttgataagccggtagccgcgtttcttgaccgacacacagaagttcacaattttatctatcagactcgcagctatcttgagctatggttaccgatgctggagaccaacaaccgcagctaccttaccgtcgctatcggttgtaccggcgggaaacaccgttcggtgtatattgcagaacagctggcagactacttccgctcgcgcggtaaaaatgtccagtctcgccatcgcacgctggaaaaacgcaaaacatgaccgtaaagcaaactgttgaagtcaccaataagctgggcatgcatgcccggcctgccatgaagcttttcgaactgatgcagggttttgacgccgaggtgctattacgcaatgacgaaggcaccgaagcggaagcaaacagcgtcatcgctctgttaatgctcgactccgccaaagggcgtcagatcgaaattgaagccaccggcccgcaagaagttgaagcgctggcggcggttatcgcgctgttcaattccggctttgacgaagactaaacctccccctctataccctatttaccccaacgccgtcccggtatttgatggcagtccccccaaaaccggacgtgttacgcctgcctcttgtcccgcagccccaccctttcgtaaggtttgtacatttcgtgcgctttaattatgcataaaaacattaagaaaaccttaaaaaatttcgtttaggttttatttaagttctttgtccatactaaatttatgtgaataaatttttccaggacttgccatgatccttttatccaaacagactccgctgggcgctggtcgacatcgtaaatgctatacgcatccggataatgcccggcgttgcataaaagttatttacaaccgtgaccacggcggtgataaagagattcggcgtgaactgagctactatgcgcatctgtcccgctacctgacggactggagcgctatcccccgttattacggcacggtagaaaccgattgcggcaccggctatgtctacgacatgattaccgatttcaacggcgcgccctctattaccctgaccgagttcgccgcgcaatgtcgttatgaagaggatgtcgctgtcctgcggcggctactgaaaaaactgaaacgttacctgctggataaccatattgtgacgatgtcgctgaagccgcaaaatatcctgtgccagcgtatcagcgagtcagaagtggttccggtggtttgcgacaatctgggggaaagtacctttatcccgctggcgacctggtcaacatggtgctgtgaacgcaaactggagagagtgtggcagcggtttatcgcccagcctgcgctggccgttgccctggagagggacgcgcagccaaaagacaagaaacggctggcgcttacttctcacgaagcttaatggcctgtgcttatcaggcctggacgacacagatcgcaggccggataaggcgttcgcgccgccaatcggcaaaattaattaagctggttgcgcgtcataaaagattccccgcccagttggcgcatctggcgcataatccacgcctgccggctacgcacatagccagaaggcgcattcgccttatagcgtaacggatttggcaataccgccgccagcaacgcggcttcagacacactcaagcgactggcaggtttatgaaaataccgttgtgccgcagcctccacgccaaaaataccatcaccaaactccgcgatattcagataaaccgtgaggatgcgctttttgctccagacagtttcaatgcccagcgttagcccggcctccagacctttgcgcacccaactgcgtccatcccataaaaagagatttttcgccgtttgctgcgaaagcgtagaggcgccgcgaatacggctctcattccgctcattatgcgccagcgctttttcaatcgccggaacatcaaagccccagtgctcagggaacttctggtcttccgccgcaattaccgccagccccatccacggcgagatatccgccatactgacccagtcagaatgcgccacataaccgaactctccgccgagccaggcgctaatctgccgttccgccatcaccgccgaaaaaggcaccggaaccacgctaaacagcgcaatgccgccgccccaaaagacggcgagcgcagcaaggatacgtaaaagtagacggcgcaaaaacgttaacggcgcgatgcgtcgtttgctcattccgccagaaccagcacgcgcgacactaatttatcaatgccgcttgccgcctgggcgatatcctgcgccagcatataggcaggggtggtcacgaccttgttatcctcgtccacaacgatatcatcaaccgggcaaggtacgtgttcggcccccatctcttcaagtacttcagcggtatcaatatccgtccctattgtcagacgtagcgggaagtcaaagattttcggcaacattgcgggcgcgatacagatgaatcccagcggcttgccggactggtgcatggccttcgccagcgcgacgacatcgctatccacccggcattcgctccccttgctggcgaaattactcaggttcttcgccgcgccgaaaccaccaggcacaatgagcgcatccagttcctctggctgagcctgggacagaggacgaatatcgccccgcgtaatacgcgccgcctcaatcaggacgttacgcgtttccgccatagcttcgccggtcaggtgattaataacatccgcttgtggtttatccggcgcgaagcagatagcctgcgcgccgctgcgggcaatggccaacagcgtcagaacggcctcatgaatttcggtgccgtcatagacgccgcatccgctgagcactacgccaatttttttcatggtgaacatcctcctgcaaccgactcaagcccattaataattttgattaaaatgctacgcttcacacatttaaatgattcatgtaacaaatcatttaggatttgctatcttaactgcgtgcggcctgaaaacaggactgcgcctttgacatcatcataataagcacggcgcagccacgatttccctggtgttggcgcagtattcgcgcaccccggtcaaaccggggtcattttttttccgcgtttgccacccaggctttcagcaccgcgacatcgtgctgccactcctgcttcatctcttcaatccattccacaacattatcttcccaggcgggaagatccggcgactggatttgctggccaagttgttgcagatgacgcagccctaccgaaccggcggcgcctttaatcttatgcccttcctcaacgacgccttttttgtcacgcgccgtcagattggactccagcacgcttaaatagccaagcatcattttttcaaacaccgcgaggccgtcggtgatcaatttaggcccaaccaactcgatgtattgttccagcatcgggatatccagcagcgcttgcgctttatcgctctcttcaggcgtcacggtactctcctctttatcggtggcatcccagaattttttaatcatcgcggttaaggctggcaccgacagcggcttactcagcacatcgtccataccagcgtccagatactcttttttatctttcagaacgttagccgtaagcgctaccagcggcggtaaatcttcccgcgtgtggcgacgggtcagttctctggcaatatccagacccgtcatatccggtagctgaatatccagtaagaccaggtcatattcgcctggcgcgaacatctccagcgccgccttgccggtcatcgcgacatccacgctgttccccagtttttccagtactgaacgcgccacaatcacgttcagttcaatatcttcgaccagcagaacatgcagcgcgggcagcggcatgtcgtcttcatcaaaggcgtcctccacctcttccgccaccgctggcgcatgaaccgttagcgtaaaggtcgatcctttgcccggcagactggaaacggtaatatcgccgcccatatttttcgccagccgacgggagaccgccagcccgataccggtccccgtcgccggcttaccgccatgactgtcttttacctgataatacatggcgaaaattttatcctgctcatcctgcggaatgccgatcccggaatcttccacttcaaagtgcagcatgtcgccttcatcataacgcgcccgcaccgtcacctggccctgctgagtaaacttcaccgcattgctgatcaaattccataaaatctggcgcagacgcgttccgtcggtaatgactttgtgcggcagcggcagcgtcggctcaagcacaaaacgtagccctttttgctgcgcctgcaaaccggaaaggttttccagatcggccataaagctggtgaaatcaaccggttggttatcaagctgaaccttacgccgctccatcttatccatatcaatgatatcattgaaaatattgcctaacgtcacggcggagacatggattgtcttaaggtatttttcctgttcggcggtaagatcggtatccagcaggatgcggcttaaaccgacgataccgttaagcggggtgcgcagctcatgactgatggtagagataaatgtggtcttgtcgcgactggcgcgctccagcgcgtcctgataacgcttacgttcggtaatatcacgaccaaatcccatcaggccatgacgtttaccgacacggtcgtaataaggcactttacgaatttcaaagcaggcctttcgtccgtccggataatccagccactgttcgtaggtcagggagacgttatggcggaatactttttcatcggtttcaatgactttctccgccgcttcgggagagtacacatcttccggcttcaaatgcaccagctgtttttcgctcttgccggttagcaattccattgcgcggttacagccggaaaactctttatcctcattacgataaaaaaccaaatccggcgaggcgtccagaaaggagcgcagaaaagaggattgctgttctagctggatttgcgcctcttcacgctctttaatttctacttttagctgttcaaatgtctcttgcagctccgcttccgctttttcgcgatcggcaatttcctgattaagctgggcaatattgtccttcaactgtacgttaagcttgagatcgcgctcgcgcatctcctccagcttttgcaccagacgcgacagtcgctgccttgactcttccagttgttcaacaacaacggataagaaatagaccgcccagggcgtaattaacaggccaaaaaagatggaacgaataacgtcgatactttcaacctgaccatgcagcaccatggtcaccgccatctgcacgacaatcgccagcaccaccaatgccaacgccaggagcatggaaaagcgcaccagacccaatttcatcatcaggtcgacatagtattgcgccagcatacgaatttgcttcatagaggattccttcaccacaacttcgcacataatacccaattatgggaaccgcgttgaatattgtgcgaaatatgcgtagccccctcatcacgctacgctacaggtggtatccagggacgggccagcgcagagccctgcacgccatgctcattcaggtatttgtccagctcaaccatccccgtccagcgattctcgcaccacagcggggcaagcagcgtcggacggcgagcgctggctgaaattcggtgataaattacctccggcggcgtatgacgaatcatctcacctgccgttagcgtgtagtcgtccagttcgatgccgttcagccgccccgcttcccaggctttggccatcgtactgcctttcacaatatgcagcggatgcagtttaataccgtcaacgcccgtctccaccacacgctccatggtttgcaggcattctgcctgcccttctcccggcagccccacaatcagatgcgcgcacactttcagcccgcgctcccgggcaatccgggtggtacgctgatagcaggcgaagtcatgcccgcggttaattcggcgcagggttttatcgtgcgcggtttgcaatcccagttccagccacacctcgtagccttgatctttatattcacacagtaaatctactactgcctgcgggacgcaatccggacgcgtaccgacgcataacccgacgatactggcctggctgaccgcctgttgatacatggaacgcagcacctgcacttctgcaaaggtgctggtgtaggcctggaaataggccagatagcgtttagcgcggttcaccagatgcgcctgatgcgcaagctgctcggcaatcgaatgatgctgctgcgcctcatcggcaaaagaggcgacattacagaaggtgcaaccgccacgcccgatggtgccgtcgcgattagggcagctaaaaccgccatgaagcgtcagcttatgaaccttttgcccataccgacgtaaaagatccccaccaaacatattgactaatttctgtaactgcataatctgatagaccgcctcttaaaaagaggccaaagcctgccatttttagtctcctttggcgatgacctggatcaatcgtcccggaaggcttttatccattgcataatcaagcaaaataaacgatatttcattcataatcccgctgatgatttttcctgatattcccctcttttttcagcgtctgctgggtcatcgataaaaacagtagcattcaatgctgttcacgcttaaaacagcataaaatgccaagatttttgaaaaagcaaggtcagataactcctggcgagcggctcttatagtgagacagatcacaggctttctgccgctccgtattagcaaccactctataaaaaaccttttaatttcaatagattaaaaagttatctgtgctacagcacacttttgcataaatcagtttgccatttgacctgggtgtggattcccgataagttggggatccgctggaagctttctggatgagccgtctgctcatcatatttatgcagtaattgagattccctcttaaccgtatttaccaatgcgcaaaggacacaaagagggcgaatgcgaggtaagcgtatgatgcgccagccccgtcgccatgctcttgctgtgcccgcgcgccgtcggttgggagagcgtcccgtagagcctggggaggttcactgatatgttgtacgataaatcccttgagaaggataactgtggtttcggcctgatcgcccacatagaaggcgaacctagccacaaggtagtgcgtaccgccatacacgcgctggcccggatgcagcaccgtggcgcgatccttgccgacggtaaaaccggcgacggttgcggcttgctgttacaaaaacctgaccgtttctttcgcatcgtggccgaagagcgcggctggcgcttagccaaaaactacgccgtcgggatgatctttttgaataaagatcctgaactggccgccgcgtcacgccatattgtcgaagaagaattacagcaggaaaccctgtcgattgtcggctggcgcgatgtgccaaccaatgaaggcgtgctcggtgaaatcgccctctcctccctgccgcgtattgagcagatttttgtcaacgctccggcgggctggcgtccgcgcgatatggagcgccgtctgtttatcgtccgccgacgcattgaaaaacgtctgcaggacgacaaagatttctacgtatgcagcctgtcgaacctggtcaacatttataaaggtctgtgtatgccggcggatctgccgcgcttctacctggatcttgcggatctgcgtctggaatcggccatctgcctgttccaccaacgcttttccactaacaccgtgccgcgttggccgctggcgcagccgttccgctacctggcgcataacggcgagattaacaccatcaccggcaaccgccagtgggcgcgcgcccgtacctataaattccagacgccgctgatcccggatttacaatccgctgcgccgtttgttaacgaaaccggttcggattccagctcgctggacaacatgctggaactgctgctggcaggcgggatggacattatccgcgccatgcgcctgttggtgccgcccgcctggcagaacaaccccgatatggaccaggatctgcgcgccttctttgactttaactccatgcatatggagccgtgggacggtccggcaggcatcgtgatgtccgacgggcgcttcgccgcctgtaaccttgaccgtaacggcctgcgcccggcacgctatgtcattaccaaagataagctgatcacctgcgcctccgaagtcggtatctgggactatcagccggatgaagtggtcgagaaaggccgcgtcggcccaggcgagctgatggtgatcgacacccgcggcggacgtattctgcattccgcggaaaccgatgacgatctgaaaagccgccatccgtataaagcgtggatggaaaagaatgttcgccgtctggtgccgtttgaagagttgccagatgaagaagtcggtagccgcgaactggacgatgacctgctcgccagctatcagaaacagtttaactacagcgccgaagagctggactccgttatccgcgtgttgggcgaaaacggccaggaagccgtcggttcaatgggcgacgataccccctttgccgtgctctccagccagccgcgtattatttacgactacttccgccagcagttcgcgcaggttactaacccgcctatcgacccgctgcgggaagcgcacgtcatgtcgctcgccaccagcatcggtcgcgaaatgaacgtcttctgcgaagcggaaggtcaggcccatcgcctgagttttaaatcgccaattctgctgtactccgatttcaaacagctcaccaccatgagcgagcatcactaccgcgccgactggcttgacattacctttgatgtcaccgaaaccacactggacgcgacggttaaggcgctgtgcgataaagcggaacagatggtgcgcaacggcaccgtgctgctggtcctctcggatcgcaatatcggtaagaatcgcctgccggtccccgcgccgatggcggtgggcgcggtgcagactcgtctggtcgatcaaagcctgcgctgcgacgccaacatcatcgtagaaaccggaagcgcccgcgatccgcatcactttgcggtactgctcggctttggcgcaacggccatctatccgtacctggcctacgaaacgctggggcgtctgattgatacccaggccatcgctaaaaactaccgtaccgtgatgcagaactaccgtaacggcatcaacaaggggctgtacaagattatgtccaaaatgggcatttcgaccattgcctcttaccgctgctccaaactgtttgaagcggtcgggctgcacgatgatgtggtaaacctgtgcttccagggcgtggtcagccgtatcggcggcgcgagctttgatgacttccagcaggatctgctgaatctctccaaacgcgcctggctggcgcgcaaacccattagcccgggcggcctgctgaagtacgtccacggcggcgaatatcacgcctataacccggatgtcgtgcgtaccctgcaacaggcggtacagagcggcgagtacagcgattatcaggaatacgccaaactggtcaatgagcgtccggctgcaacgctgcgcgatctgctggcgatacatccagacggcgaggcggtgactatcgacgaggttgagcccgccagtgagctgtttaaacgctttgataccgcagccatgtctatcggcgcattaagtccggaagcgcacgaagcgctggcggaagcgatgaacagcctcggcggcaactccaactccggcgaaggcggcgaagacccggcgcgctacggcaccaataaagtgtcgcgtatcaagcaggtggcttccggccgttttggcgtgacgccagcgtacctggtcaatgccgatgtgattcagattaaagtcgcgcagggcgcgaaaccgggcgaaggcggtcagttgccgggggataaagtcactccgtatatcgctaaactgcgctattcagtgccgggcgtgacgctgatctccccgccgccgcaccacgatatttactctatcgaggacttagcgcagctcattttcgacctcaaacaggtcaacccgaaggcgatgatctccgtgaagctggtgtccgaaccgggcgtcggcaccatcgcgaccggcgtggcgaaagcctatgcagacctcatcaccatcgctggctacgacggcggtaccggcgcaagcccgctctcttcggtgaaatacgctggctgcccgtgggaactaggacttgttgaaacccagcaggcgctggtcgccaacggtctgcgtcacaagattcgtctgcaggtggacggcggtctgaaaaccggcgtcgatatcatcaaagcggcgattctcggtgcagaaagtttcggcttcggcaccggcccgatggtggcgctgggctgtaaatacctgcgcatttgccatctgaacaactgcgcaaccggcgtggcgacgcaggatgaaaaactgcgtaagaaccactatcacggcctgtcgttcaaagtgaccaactactttgaatttatcgcccgcgaagtgcgcgagctgatggcttcgcttggcgtgacccgcctggtggatttgattggccgcaccgacctgctgaaagagctggagggcttcaccgctaaacagcagaagctggcgctgtctcgtctactggaaaccgctgaacctcatccgggtaaagcgctgtactgcaccgagaataacccgccgtttgataacggtgtgctgaatgcgcaactgttgcagcaggcgaagccgtttgtcgatgcgcgccagagcaaaaccttctggttcgacatccgcaacaccgatcgttccgtgggtgcgtcgctttccggttacatcgcacagacccacggcgatcaggggctggcttccgatccgattaaagcgcacttcagcggtaccgcaggccagagctttggcgtgtggaacgcgggcggcgtggagttatatctgactggcgatgccaacgactatgtcggtaaaggtatggcaggcggtttgatcgccatcagaccaccggtaggttccgccttcctcagccataaagccagcatcatcggcaacacctgcctgtatggagcgaccggtggccgtctgtacgcggcggggcgcgcgggcgaacgtttcggcgtgcgtaactccggggcgattaccgtagtagagggcatcggcgacaacggctgtgaatacatgaccggcggcatcgtctgcgtgctgggtaaaaccggcgttaacttcggcgcggggatgaccggcggcttcgcctatgtgctggacgaagatggcgaattccgtaaacgcgtgaacccggaactggtagaagtactggacgttgattcgctggctatccacgaagagcatctgcgcggcctgatcaccgagcacgtgcaacatactggttcgcaacgcggcgaagagatcctgtccaggtggtcaagcttctcaacccaattcgcgttagttaagcccaagtccagcgatgtcaaagccctgttgggccaccgtagtcgtagtgcggcagaattgcgcgtgcaggcgcagtaaggaattgaaatgagccagaatgtttatcaatttatcgacctgcagcgcgttgatccgccgaagaaaccgctgaagctccgtaagatcgagtttgttgaaatctacgaaccgttttctgaaggtcaggcgaaagcccaggcggatcgctgtttgtcctgcgggaacccctactgcgagtggaaatgtccggtacataactacatcccgaactggctgaaactggctaacgaagggcgtatttttgaggcggctgagctatcgcaccagaccaacaccctgccggaagtgtgtggccgcgtctgcccgcaggaccgcctgtgcgaaggctcctgtacgctgcacgatgagttcggcgcagtgaccatcggtaacattgagcgctatatcaacgataaagcgttcgaaatgggctggcgcccggatatgaccggcgtgcgccagacggacaaacgggtagcgattatcggcgctggtccggcagggctggcgtgcgccgacgtgctgacccgcaacggcgtgaaggcggtggtctttgatcgccatccggaaatcggtggtctgctgaccttcggtattccagctttcaaactggaaaaagaggtgatgacccgtcgtcgcgagatcttcatcggcatgggtattgagttcaaacttaataccgaagtgggtcgtgatgtacagcttgaagatctgctgaaagattacgatgcggtattccttggcgtcggcacctatcagtcgatgcgcggcgggctggaaaatgaagatgcggacggggttttcgacgctctaccgttcctgatcgccaatacgaagcagatcatggggtttggcgaaaccagcgacgaaccatatgtcagcatggaaggcaaacgcgtggtggtgctgggcggcggcgataccgcaatggactgcgtacgcacttccatacgccagggcgcaacgcacgtaacctgtgcttatcgtcgtgatgaagagaacatgccgggttccagacgcgaagtgaaaaacgcgcgcgaggaaggtgtcgagtttcagtttaacgttcaaccgctgggcattgaagtcaatgccaacggcaaagtgagcggcgtaaaaatggtgcgcactgaaatgggcgaaccggatgccaaaggccgtcggcgggcggagatcgtcgccggttccgagcatgtggttccggctgatgcggtggtgatggcgtttggttttcgtccacacagcatggaatggctggcgaaacacagcgtggaactggactcgcagggacgaattatcgcgccggaacgcagcgataatgctttccagaccagcaacccgaaaatcttcgccggtggcgacatcgtgcgcggttccgatctggtggtgacggcgattgccgaaggccgtaaagcggctgacgggattatgaactacctcgaagtgtaaccctttcggctccccggttgatgccttgtgctgatggctggggagccgatattcctctcctcaatatctctcctgccgattctggaaacccgctcgtaaatcgagatgtaatgccatgtaaaatccgttcatggattgattcgtttacgcctgaagcgtattgatagcgttctaatttcacaatgaaactatcacgtaagggatgacatgacgaatccaactttagcgccacagtctgatgaatatcagcaaattcatgacggtattattcgtctggtcgatacggcacgtaccgagaccgtgcgcagcatcaatgccattatgactgccacctactgggaaattggccgacgtattgtcgaatttgaacagggaggagaagcgcgagcggcctatggcacccagcttatcgaacgattatcggtagatttaagtcagcgctataagcgcggtttttccaacagaaacctatggcaaattcgtacattttatctttgttttcaacacattgaaattccgcagacactgtctgcggaatcttcaaatctcataccgctcgccaaaacattccctcttccctggtcagcttatgtgcgtctgctgtcggtgaaagataacgatgcccgcactttttacgagaaagagacgctacgtaacggctggtccgtacggcaactcgatcggcaaatcgccactcaattttacgaacgaacgctactgtcccacgacaaatccgccatgttgcagcagcctgcacccgccgagccaaacgttttgccggagcaagccatacgcgacccgttcattctggaatttcttaacctgaaggacgagtattccgaatcagatctcgaagacgcgctgctcagccacctgatggactttatgctggagctcggtgacgattttgcttttgttggccgccaacgccgactacgcatagacgatagctggttccgcgtcgatctgctgttcttccatcgtcgcttgcgctgcctgttgctcgttgacctgaaggtaggcaaattcggttatgcggatgccgggcagatgaatatgtacctgaactatgccaaagagcactggacaatgcccggagaaaacccgccagtcggcctggttttgtgcgcagggaaaggcgcgggggaagcgcattacgcgctgactggcctgccaaacaccatcatggcgagcgagtacaaagtgcagttgcccgacgaaaaattactcacagacgaacttattcgttcgcaaaccatgctggaaactcaactcacacgcggtggttcactgacaacggagaaaaactagcgaaccattaatgccatgaataattatcaaaaaaaatatcacacgaaaacgtttgctttattctgagaactgtatattatgcggcggattttttgggcaaaattcatggaggcgttgtgtcgcaggacaacaattatagccaggggccagttccccaggcggcgcggaagggcgtgattccactgacgtttgtcatgttgggtttaacgtttttttccgccagtatgtggaccggagggacactcggcaccggtcttacctatcatgatttcttcctcgcagttttcttcggtaatctcctcctcggtatctacactgcatttcttggctacatcggcgcaaaaaccggactctccacccacctccttgcacgttactcctttggcgttaaaggctcatggcttccctcactgctgttaggcagtactcaagtgggctggtttggcgttggcgtagcgatgttcgctattccggtcagtaaagcgacgggcattgatgccaatatcctgattgccgtttcgggtctgctgatgaccctgaccatttttttcggcatctcggcgttgaccattttgtctatcgttgccgtacccgcgatcgttattctgggcagctactccgtctggctggcggtcagcggcgtgggtgggctggagcatttaaaaacgatagtgccgcagacgccgctggatttttccagcgcgctggcgctggtggtgggctcgtttgtcagcgccggtacattgaccgccgacttcgtccgcttcggacgtcatgccaaaagcgccgtactgattgcgatggtcgcttttttcctcggtaactcgctgatgtttatcttcggcgcggcaggcgctgccgccgtcggtcaggcggatatctctgacgtgatgatagcgcaggggctgctgctgcccgcgattgtggtgcttggcctgaatatctggaccaccaacgataacgcgctgtacgcatcgggtctgggcttcgccaatattaccggtctttccagccgcacgctgtcggtggtgaacgggattatcggtaccgtgtgcgcgctgtggctttacaataattttgtcggctggctgacgttcctgtcatctgccatcccaccgattggtggagtgattattgccgactatctggtgaaccgccgccgctatgccgacttcaacaccgtgcgctttattcccgttaactggattgctattctttccgtcgcgctgggcatcgccgccggacattatgttcctggtattgtgcccgtcaacgccgtactcggcggcgtcttcagctatatcctgctgaatccacttttcaaccgcagccttgctaaatcaccagaggtcagccatgcagaacaataacatcactattcgtcagacgcgtctgcagggacacgaaggattatggcagattacgattgaaaacgggcgctttagccggattgagcctcaggaagccacatcgttaccgcagggcgaagtgcttgatgccgaaggcggtctggctattccaccgtttgttgagccacatatccacctggataccacgcaaacggcgggtgaaccgagctggaaccagtccggcacactgtttgaagggattgagcgctgggcagaacgtaaagcaatgctcacgcatgaagatgtgaaagcgcgcgcgatgcagaccctgaaatggcagatggctaacggcatccagtacgttcgtactcacgttgacgtttcagatcctacgctcaccgcgctgaaagccatgctggaagtgaagcaagaggttgcgccgtgggtagacctacaaatcgtcgcctttccgcaagaaggtattctgtcttatcccaacggtgaagcgctgttagaggaagccgtgcgtttgggcgctgacgttattggcgccattccgcactttgagttcacgcgggaatatggcgttgaatcgctgcacaaaaccttcgccctggcgcaaaaatacgatcgcttgatcgatgtgcactgcgacgaaattgatgacgagcagtctcgctttgtcgaaacggtcgcggcgctggcgcatcgtgatggcatgggggcgcgcgtgaccgccagccacaccacggctatgcactcgtacaacggcgcgtatgcgtcacgcctgttccgtctgttgaaaatgtcggggattaacttcgtcgccaacccgctggtaaatattcatctgcaagggcggtttgacacttacccgaaacgtcgtggcgtcacgcgagtgaaagagatgctggaagcggggatcaacgtctgctttggccatgatgacgtcttcgacccgtggtatccattaggcaccgccaatatgctgcaggtgctgcatatggggttacacgtttgccagttgatggggtatgggcaaatcaacgacgggttaaatctgatcactacccacagcgcaaaaactttgcacctgcaggactacggtctgagcgtcggcaatgccgcgaatctggttatcttacccgctgagaatggattcgatgcggtacgtcgccagacgcctgcccgttactcaattcgccacaggcgggtgattgccgagacggtgccgagccagacgacgctgcacctgacccagccggaagccgtgacgtttaagcgttaacccgtcatacccgcgctctccggcacattcaccacgcagcccgtaaggggctgcgttcggaagactgctccggcaagagattcaggccgccagcaaactggcgcgtactttcactaccactttcttgatgtcatccggttcacccactgcacatcccggtttatgcggttctcccggcataaacacagcaaacatccccgcttgcagcgtaatagtctgctcgtcggcaatttgactacaaagctggtaatcctcttcaacgtgcatctcctcgcactggcgagcggcaccggacatcccaaacgcaatacgctcgacgccggttagtagtagctgaatatcaatgtattgttcatgcaattccgctttcttcccggcaggcatttgcgtcgttaactgcattacattcataaagatattgtcgccctgcaattcatagcgccccggtgctttctcctgcggccttgccgccagcgcgagagtcaaggcatccagcagtcgcggatgcaacccgcaagaaggcaacgactgtacttcccccatcatcataatgtgtctccttgagctaacaaagcagcgcctaataatcctgcgtcatgccgatagcgagcggcgctcagcgccacgtgataaggctcaggctcttgcatcaaaaacgcgcgaacctgctccaggtatccctcagctaaccctacgctgccgccaatgaccacacactggcagtcggtaatcgctttcacatcggcgatcattcgcgctattacctgcgcggattggcttaccagatgtcgcgcctgctgatgaccttcgccagcgcgaataaatagggttttggcgtcgcatcccgccagatcgtcccgcgccgccgcggccatccctcgtccggaggcgatggcctctacacaaccaacgcgtccacagccgcatacgggcccgtgtgggtccgccagggtgtgtcccaggtgcccggccagaccgccttttccggtaaggagcttgccgtcgcagacaacgccgccgccaacgccggttgaaacggtgataaataccatatcgcggatatcatcagggagcgcgtgatactccgcccaggccgccgcctgcgcgtcgttcaccgccagcgtcggcaggccagcgatcgtttccagtgtttgtactaacggaaagtgtagcaagccgcccagattatgggggtttagcgccagcagcatcccttcctgaatgatcccggtagaagctatcgctacctgacgcgcctctgcccgtagtggttcaaccagcgcctttaatgcttcacgtaacgcatccggcgttttgctcgcgggggtcggtagctcgcgacgctggctaatgcgcaagttgttgtcgatgagcgcggcggcaagtttagtaccgccaatatcgattgctaacgtagtcatgacgccgccttttttaatgcgtcgttataccatccacagatatgttccagacgggtaatggcggaccccaccgtcaccgcccatgcgccatagcggatcgcctccgccgccagtgctggcgagttatagcgcccttcggctattacccggcatccggcgtcatgcaacgctttgactaagggcagatcgggttcctccggcgtatcgggggtggtgtagccggacattgtcgtgccgataatgtccgcgcccaaccgttggcaggcgagaccatcgtccacggatgagcagtcggccatcgccagtagatggtggtgatgaatgcgcgccaacaacgcctcaacggctaccggccgttgccgagcggttccatcaacggcgataatagctgcgccagcgcatctacatcgtcgagaaaaggggtaatgcgcactggagagtcgtccagatcgcgtttgataatgccgataatgggtaccgaaacgagcgaacgggccacgcgcaggttgtctatgccttcaatacgcaccgcaaccgcgcccgcctgttccgccgccaacgccattgccgctacaatctccggcttatccagcggactgcccggaacgggctggcaggagacaatcaggccgccagaagcggcaatatttttatccagttgttcaagtaacgacatactactcccttacaaatattgcccgattgaaaaccgggcaagcggattaacttttcgtttttacaaaggcacctttaccactgccaagcggtacggctccgctgaacgttttgtcgtcgatagcatcatgggtgcgtaacgcttccggacgtagccaacgctgtacgcgagacggcatatcaagcccaataagcaggatcacgacaaacgtcaggctgaaagagagcgatgccagcgcagtgcccagatccagacgttgagcgatcagcgctcccaggatcggtgccagcgcgccgccgagcgcgccgacgttataagtaaagcccagccccgccgcgcgctgatcggtatcgaagtaaccgccgatcagtttcggcagaatcccggcaatcccctgccccaacatctgttggaaaaacagtagcagacccagaacccagacgtttgtgccgccaatcgcaaagaccggaataatgaggatttgcgaggccagcaggctacagacatatgctttacgcgttcccagccagtcgccaagaaaaccgcctacgcaacaaccaaccgccgcgccaaatccgctaaagaacaggacattcgccaccgtatgcggatcgtaggccagctcggttttcagataagtaggtaatagcgcctgaatcggccaagaatagaggaaagcaaacagtaccaccagcatcagcatgacgccagtgggccagcgtttaccgctgctctgcaccataaagctgataaagataaccgcgcacagtagtcccagccccgccacaatcgcagcattttgtaggttaccggcaaaacagaaccacagcgcagcggcggcggcgaaggtcattaaaatgttgatgatacgatgttcgccccgataaagaatgtcgaccatcgtgcgtaccggcgctttacccgcgtgtttttctttccagtcttccgcttccggaatgtttttccgcagccagagggcgaagataattggcaaaatgccaatgaaaaacagcgcgcgccagccccagacaggcaccaccaggctgtacacctgcgcggcaacgaccgcgccgacggagaagccggaaatcagaaaaccactggctttattgcgtaaatgttttggccagctttcaatcacataggtcgcgctggaaccatattcgcccgccatgcccataccaatcaccagtcgggcgatgaacatggtggtgtaaccgggcgcaaacccgcaggccagggttcccaccgaaaacagaatgatgctgctgaccatcgccagacgacgcccatagcgatcgcccatcgcgcccaataataacccgccgaaccagcgagagataaaagccgcagaaatcaggcttgccgcctgtaccgtcgtcagcccaaattcgctttgtacctcagtcagtacaagagcaattaacacaaaatcaaaaccatcaagcagatatcccaaccaggcagcggaaaatgcccgccattgcgcccggttgagatggcgataccacgggatgttctgggtagaagtactcattttactctcccgacgatttttgttgtcgttatgccgaatggcggctccgccttatccggcctactgttcgcactgttgtaggccgggcaagcgtagcgcccccggcattatgctgttacgccttttcttccatcagttgttgagccagcgccttgagcgccggcagatatttttcatcaacaggcgcaaacggtttacgacatagcggcaccgataccacgtccatataatgcaggaccgttttcaggccgcggaatacgccggttttaatcagtaaatcaataaccttattgcactcggtttgcagacgctgcgctttcgccacatcgccctcacgcaatgcctgaacaatcccctgataacgccaacccataatgttgtatgtgctgccgataccgccgtccgcgcccgccagcagaccggaagcgaagatttcgtcataaccgttgtacagcaccagatccggatgcgcgcggcggatctgctccatctggaagagatcgccggaggtttgcttcagcgcgttcacgcccggtaatgtcaccagcgtattgatctgatcgagggtaagttttacgccgcttaacgccggaatgttgtataccaccatcggcaatccatctgcggaatcaatgattgcccgataatggtcacagtgctcttcaaaactgaaagggtaataaaaaggcgtcaccgcagagaccgcatcaaaaccgtaacgctttgcggcgctggcaagctgctggctttctgcggtgcttactgtcccgacatgggcgatcaacgtgatttttcccttcgcctcttcggcgacaatctccagtacctgctctctttcagcaaggctctgtacgaatgcttccccggtggaaccgccaacgtacagcccgtcgataccctgcccgatgttaaaacgcaccagacggcgcaggctttcgctatccagttgctgctgatgatcaaatggggtcaacaacgccgccattacgccttgcaatgcttttgccatacctacctctacggatgatgaatatattaactacctacctttatacctgttataccagatcaaataagcagcaaataatacagaacgcttatagtgcgatctgcttcactaaaccgggatcggaggtgcgatcgctaccgcattttttgactttttttaccgagcgcgtgccaggtagcggaaacgctattgaggtgggtttgcagagcgcgatccgctttatcgggatctcgctggcgaatggcatcaacaatcacaatatgctgttgataactcacgttattatgttcatgcagctcacgatcgggaacgcttgggcgagcagcgattagccagtccagcagagcaacatgaatagccataaagatcggattgccgggaatttcagccagcacccggtgaaactcgacatccgaacgaataaacagcgcgttgtcatccagcgactggctattaatttccagcgctttcgttaacaacgcgatctgctcgtcggtggcatgttccgccgcatagcgtaccaggctggattcaaagaaaagccgtagctgttcaaagtgagcgatgccgccaggatgagtaagaaaatctttcgccatacccgacagttcgctgatgatggtatcagcagaggggcgcgagacgcgggcgcgttcgccgttattgatttgcaccagacctttacgcttcagcgcagctaacgcttcacgcacggagggacgtcccacattgaagaaggccattaattcacgttcagacggtagctgttctccctcgccaaactcatgacggcggatcatctgctccagctcttcctcaaccatttcagacagttttttacgcgccagcgggcggcggcgcaaactacgcccgagggatgtcggtgaatcttctgcttgcgaatcaaatgcgttcataacgtccattcatgagtggtcggtggcaaataatagcaagcttatcgtaacacagcttcaaaagcagggtgaacccgcgaggagaccaaacaaaacaggcccttcagggcctgttgattattttactacgcgcagcgccggacgtccgccacgcggcggaggcggctcgtcatcaggactactgtcgtcatcgtggtcgggcttatcgccatcaatgacggacatcacggtctcgctttccgcgcctgcggtattgtcatcatcatttaagctgacaacgtcttcatcataggcggcttcaggctcaaacatggtgcctgcgccgttttcacgggcgtaaatcgccagcaccgcagccaaaggcacagaaacctgacggggaacgccgccgaagcgcgcattaaaacgcacttcatcattagacagctccagattacctaccgcccgcggcgcaatattgagaacgatttgcccatcgcgcgcatattccatagggacatgcacgccaggcagcatcacatccaccaccagatgcggggtcaactggttatccagcaaccactcgtagaaagcacgcaacagatagggacgacgcggcgtcaactgtgacaaatccatacaggttaaccccgaccgaggcgcatttcacgttcagcttcggttaaagaagccaggaaagaatcacgttcaaagacgcgggtcatatagcctttcagctctttcgcccctgcgccgctgaattcgatacccaactgcggtaaacgccacaggagaggcgccaggtagcaatcaaccaggctgaattcgtcgctcaggaaatacggtttctgaccaaataccggcgcaatcgccagcagctcttcacgcagttgtttacgcgcagagtcgacctcggaagcagacccgtttacgatgacgttcatcagcgtataccagtctttttcaatacggtgcatgtacagacggctttcaccgcgcgcgaccggataaaccggcatcagcggcggatgggggaaacgctcatccagatattccataatgatgcgagattcccacagggtcagctcacgatccaccagtgtcggaacgctttgattcgggttgaggtcaatcagatcctgaggtggattgtccttttccacatgttcgatctcaaaactaacacccttttcagccaacacaatgcggacctgatggctatagatgtcagtaggaccagaaaacagcgtcattaccgaacgtttgttggcagcgacagccatgaaaacctccaggtatattcagaatttttactgctaccagccacaatgtgaccagccagatgttatgtcacccagggcgaaaaaagccatcattgctcagaaacgagacaaaaaatgaacattccccgctatttgggcagaaaattggatgatagtttaccagattttgtgacctttgtggtgagtcgattctggaattggggaaaaagagacaacaatccgcatttcattgtgacagataaatgcattgcccataaaaaaacccgccaaagcgggttttttcgctaacagttgtctgccgaagcagaaaacaattaacgtttggagaactgcggacgacgacgtgctttacgcaggccgactttcttacgttcaacctgacgagcgtcacgagtaacgaagccagctttacgcagttcgccacgcagggactcgtcgtactccatcagagcgcgggtgataccgtgacggatcgcaccagcctgaccagagataccaccacctttaacagtgatgtacagatccagtttctcaaccatgtcgaccagttccagcggctgacgaactaccatgcgggcagtttcacgaccgaagtactgttccagagaacgttggttgataacgattttaccgttgcccggcttgatgaaaacgcgagctgcggaacttttgcggcgaccagtgccgtagtattgattttcagccattgcctataatcccgattagatgtcaagaacttgcggttgctgtgccgcgtggttgtgctcgttgcccgcgtaaactttcagtttacggaacatagcacgacccagcgggccttttggcagcatgcctttaaccgcgatttcaatcacacgctcaggacggcgggcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaaataaataagttacacgttggtgaacacccaaacgtttaaatagttgaggttcacacgacaaagtccggtaaacctaccccctcggatatgtttggccggcacagagaaagtttgggaaaaaactctcttgtaacgtggggtcgcaggattatagagaagtccaggtcaaagatcgacccctttttgcgatttgccgcgggttttgttcaggcctagttcaccctcggtcggggaggttgcacagatataataccgcataatgccggagcgctacgcttgtccggcttacggcatatgctcccgcttgagatactccgcactctgcatctcttgcaggcgcgacagacagcgctgaaattcaaacttgagtcgctccccctgataaatctcatataacggcgcggcggcgctgaccaccagcttaacgtggcgctcgtaaaactcatccaccagcgcaataaagcggcgcgcttcgttctccatcagcggcgtcatgaccggcacgtcaaacaacagaaccgtgtgaaataaccttgagagcgcaatgtaatcatgctggctgcgagcctcgacgcacagcgtagcgaaagaggccgctaacgtttggttttcaacgcccagggtggataaagggcgatgattgatttccagcgtcggagcatgttctcgtgcggcccccgctaacgccagccacagtttatccatttgccgccgggtttcatcattaagcggcgttagccataaatgggcctgcgtcagcgtccgcagccggtaatcgacgccggcgtccacattcataatgtcgcagtgctgtttaatggcatcgatagccggcaggaagcgggcgcgttgcaaaccgttgcggtagagttcctccggcggaatattggaggtcgcgaccagcgtaatgccgcgtgcaaacagcgctttcattaaaccgcccagcagcatggcgtcggtaatatcggtgacgaaaaactcatcgaaacacagtacgtccgtctcggttttaaaccgatcggcaataatgtctaacggatcgatctgtccctgtagcgcggtaagctcttcatgcacgcgcagcataaaccgatgaaaatgcaggcgcaattttcgctcacccggcaggctgtggtagaagagatccatgagccaggttttgccgcgacccacgcccccccacatatacagcccgcgaaccggtatttgcgcgtccggttcgtttttgcctaataatttccccagtcgcgctatcagaccgccgggtggcgtagccgacgattttttcgcggtgagcgcctgataaagggtttccagacggtcgaccgcctctttctgtacgtcgtcaggctgatgggtgccttcgttgagtgcctgaagataacgcgatgtaggggaaagactttgcataatgttattgttattccttgaaaatcgatgtgccgtcgttcacggctgacgaaaaaaaggccgttctacactacgcgatatgctgtcgggattccacttctacgaaattagcggttatagtggcataatcaggcgcgggcatggagcctggagccaacaccctacggaaacataagacaacgggagatgttcatgacctgggaatatgcgctaattggattagtcgtcggtatcatcattggtgccgtggccatgcgttttggtaatcgtaagttacgtcaacagcaggcattgcagtacgaactggaaaaaaacaaagctgagctggaagagtaccgtgaagagctggttagccactttgcccgcagcgcggaactgctggataccatggcgcatgattaccgccagctgtatcagtatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaatcgcacgccgttaagaaatttatcgggcgcatcgcttgcgccctctctctatctttcctgtcccagctattatcattgttaccaggctgaaaattcaataacatcaatctgttttgaattgtctatccgttcattcaaggtacgagagcagcatccatgaaaaaacacacccagctgttaagtgcattagcgttaagtgtcggattaactctttcggcaccgtttccagcccttgcatcgataccaggccaggtgccaggccaggcgacgctgccaagccttgcccctatgctggagaaagtgctgcctgctgtcgtcagcgtaaaagtcgagggaaccgccacccagagccaaaaagtgccggagaagtttaaaaaattctttggcgaggatctgccagaccagccgtcccagccgtttgaaggactcggttcgggggtgattatcgatgccgcgaaaggctatgtattaaccaataatcatgtgattaatcaggcacagaagatcagcattcaactgaatgacggacgcgaattcgacgcgaagctgatcggcggcgacgaccagagcgatatcgctctgttacaaattcagaatcccagcaagttaacgcaaattgccatcgccgattccgacaaactccgcgtcggcgatttcgccgtggcggttggtaatccgtttggccttggacaaaccgccacctccgggattatttcagcgctgggacgcagcggacttaatctggaagggcttgagaactttattcaaaccgatgcctctattaaccgcggcaactccggcggcgcgctgcttaacctgaacggcgagctgatcgggattaataccgcaatcctcgcgccagggggcgggagcatcggcattggctttgctattccttccaatatggcgcagacgctggcgcagcagttgattcagttcggcgaaatcaaacgcggattgctgggaattaaaggcactgaaatgaccgctgatatcgctaaggcattcaaactgaacgttcagcgtggcgcttttgtcagcgaggttttacccaattcaggttcggcgaaggccggggtgaaatccggagacgtgattatcagtcttaacggtaagccgctgaatagctttgccgaactgcgttcacgtatcgccaccaccgaaccgggcacgaaagtgaagctgggcctgctgcgcgatggtaagccgctggaggtggaagtcacgctggattccaatacctcttcttccgccagcgccgaaatgatcgccccggcgttgcaaggcgcgacgttgagcgacggccagctgaaagacgggacgaaaggcgttaaggttgatagcgtcgaaaaaagcagtcctgccgcgcaggccggtttgcaaaaagatgatgttatcatcggcgttaatcgcgatcgcatcagttctatcgccgaaatgcgcaaagtgatggcggcaaaaccgtccatcattgctcttcaggtagtacgcggcaacgagaacatttatctattgctgcgctaatcctgtcttaaaccgggcatcagcctgcgatgtgatgtccggttaactcatggtatgctgctgccgttcccttttttaacgacgcctccatcatgtttgtgaagctcttacgttcggtcgcaataggtttaattgtcggcgctattctgttggccgtcatgccttctttgcgcaaaattaatcctatcgccgtcccgcaattcgacagtaccgatgagacgccagccagttataattttgcggttcgccgcgccgcgcctgccgtcgtcaatgtctataaccgcagtatgaacagtaccgcgcataatcaactggagatccgcacgctgggttccggcgtgatcatggatcaacgcggttatattattaccaacaagcacgtgattaacgatgccgatcagattatcgtcgcgctacaggatggccgcgtctttgaagcgctactggttggctccgattcgcttaccgacctggcggtgctgaagatcaacgccactggcgggctgcctaccatcccgattaatacaaagcgtacaccgcatattggcgacgtcgtactggctatcggcaacccatataatctgggacagaccatcacccaggggatcatcagcgcaacgggtcgtatcggcctgaacccgacggggcgacagaattttctccagaccgacgcctcgattaaccacggtaattccggcggcgcgctggtcaactcgttaggcgaactgatggggatcaacaccctctcttttgataagagtaacgatggcgaaacgccggaaggccttggttttgcgattcccttccagctagccacgaaaattatggataagcttatccgcgacggtcgcgtgattcgcggctatatcggtattggcggacgagaaatcgcgccgctgcacgcgcagcagggtagcggcatggacccgattcagggcattgtcgttaatgaagtaacgccaaacggccccgctgcgcttgccggtattcaggttaatgatttgattatttcggtcaataataaacccgccgtgtccgcgctggagacgatggatcaggtggcggaaattcgcccgggctccgtcattccggtcgtggtaatgcgggatgataagcagctcacgttccaggtgacggtgcaggaatacccggcgtcaaactaaaacgacgcagcttttgcctgcgtcgttcgacggctagtcaataaagactggccctgccggaaaatgcgccaggaaactcgtgaagattagcagagcggggaaactcttttccccgacggcctcttcacgcagcgccttatcgagtgtcaataagccagactcgctcccttcccccagaatgccgcccatccagagcagtcgttgcgcctgttgacgcgcatactgcgatgcgcttttccaggcgaccagatgcagcaacgtttgtaacagcaggacccgagacgcgtgaccatcgcgttgtaatcgcctgaatacgggtaatgcaatactacgcaccgtcgagaaaccgctcgccgcctccccctcaatcggcgataaaccaacagccgcctgtttgacgaaatcgcataaccgattgtgtgttaatggccgctcgcctgcgctcatataccctgcggcgaaacagagtaacccgataccctgagcccaatcggtcgatggcagaatcccctgcggaacattcggtgccgacgtctgtgcggcacaaagcccctcgtcgtaacactgtgcaaaacgttgctcatatattgctgagttgacgccggaccacggcagcaaatgcagcgctggctcaagctcagttatctgattcaccgtctcaacaacataacgcaagatggtttctctggatggcatggatgtaccttgccgaaacgcaaccatttcactcattactgtgtcctcattttgcgggagcataatcactgctcccgattagaattggattacattgccagcacgtacttcagcatcacgcccgccgcaatggccgaaccgataaccccggccacgttcggccccatcgcgtgcatcagcaggaagttctgcgggttcgactccaggcccaccttgttcgacaccctggctgccatcggcactgccgacaccccggctgaacctatcagcgggttgattttgttcttactgcacaggttcagcagcttcgccatcagcaccccggccgccgtcccgataccaaaggcaatcacccccagcagcagaatgcccagcgtctgcggctgcaggaacttatccgcgaccagcttcgcgcccaccgacagcccgaggaaaatggtcacgatattaatcagaccgttctgcaccgtgtcgctcagacgctccaccaccccgctttcacgcatcagattgccgaagcagaacatccccagcagcggcgcggcgtccggcagcagcagggccaccagcagtaacagcaccaccggaaagaggattttttcccgcttactcaccgtgcgcagctgcaccatgcggattttgcgctctttctcgctggtcagcgcgcgcataatcggcggctggattaacggcaccagcgccatatacgagtaggccgccaccgcaatggcccccagcagctccggtgccagcttgcccgacagataaatcgccgtcgggccgtccgcgccgccgataatgccgatggccgccgcctgcggcagggtgaaggcaatcaggccgaagtagttcagcgtcagcgcccccagtacggtggcgaagatgccgaactgtgccgccgcccccagcagcagggtgcgcggattggccagcagcgggccgaagtcggtcatcgcgccgacgcccataaagatgaccagcggcgcgacgccggagccaatcgccactttatagaacagcgccagcacccccggcgtgtagcccatgtccaccgccagattttccatctggttctggactgacggcagggccagcgccagcgcttccttgatggcgtgcacgtccggcgcgcagttgagcttcgcggcaatcaccgccagctgcccggcgtcgtgatgggccagcaggctctccagcgcggtcagcgccatgcccgcttccgggatgttggagagcaggccgccgaagcctatcggcagcagcagtaacggttcgaactttttcgctatcgccagccacagcaacagcaggctgaccagcagcatgatggcctggcccgcgccaaggtgcatcagccccatgccctgaagcagggcgttcagactttccatttcagttctccgttacgccagcgtcatcagggtgtcgcccacggagacggcgtccccggacttcaccgcgataccgcggacggtgccggcctgcgcggcgcggatttcggtttccatcttcatggcttccagaatcagcagcacgtcgccttcggccacgctctggccttcggtggcaatcaccttccagatgttgcccgccagcggcgcggtgaccggggtgccggcgcctgccggggcggcagcctgaaccggtgcggaagaggccgccggaacagccgtagtaagctggctgatatcgccgccgtcgctgaccctcaccacaaaggctttgccttccacttccacggtgtagataccggaggcggcaggcttctctgcttttgccaccggctgcgcggcttccgcctgcggcagtggctcaaacgccgccgggttatggcggttctcaaggaatttgaggccgatttgcgggaacagcgccacggtgagcacgtcgtcgatggcgtttcccgccagagtaatccccttctcctgcgcctggcgcctgacgtccgcttccagttcagccagctccggcttcagcaggtccgccgggcggcaggtcaccggagcgctcccttccagcacgcgggcctgtaacgcggcgttaaccggcaccggggtgtggccgtattcgcctttcagaatgccggcggtttccttcgcgatggttttgtagcgttcgccggtcaggacgttgagcaccgcctgggtgccgacaatctgcgaggtcggggtgaccagcgggataaagccgaggtcctcgcgcacgcgggggattttcgccagcacctggtccagcctgtccgccgcgttctgctgcttcagctggctttcgaggttggtcagcatcccgcccggtacctgcgccaccagaatacggctgtcgtagcctttcagctggccttcaaaggcatggtactttttgcgcacctcgcggaagtacgcggcgatattttccagcttcaggatatccagcccggtgtcgtgctcagtacctgccaacgtcgccaccagcgcctcggtggccgggtggccgtaggtggcgctcatggacgaaatcgccgtgtccacgccgtcaacatccgcctcgatagccttcagcagggccatctccgccatcccggtggtggcgtgacagtgcaggtgcaggcgcacctcaaaacgttttttgatttcgctcaccagctcaaaagcggccatcggcgtgagaatgccggacatatccttgatggcaatcgagtcaacgccggtctctaacaactgttcggtcaggtccagccaggtctgcagggtgtgcgccgggctggtggtgtaggagagcgtcccctgggcgtgcgcgccgtggctgcgcaccgcctgcagggcggctttcatattgcgcgggtcgttcatggcatcgaagacgcggaacacatccatgccgtttttcaccgcgcgttcaacgaagcgctccaccacatcatcggcgtagtggcggtagccgagcaggttctggccgcgcagcagcatctgcagcggggttttgggcatggcttttttgagttcgcgcaggcgcagccacgggtcttcgccgagaaaacgaatacaggcgtcaaaggtggcgccgccccagcactccagcgagccgtagcccacgtcgtcgagctgagcggcaatcggcagcatatcgtcaaggcgcaggcgggtggcgaacagagactggtgggcgtcacgcaggacgacgtcggtaatggcaatagtcatggatccctccgggaattaagcgttaaggcggtgatggtgaatggcggcggcaatcaccggctttaagcgggtgaagtcgtccacggcgggaacggcgcgcggtgcgggcgcggcgacgggttccgggaagaagcgagtaatcacggcagacataccgcgaatggcaaagatcagcaggaacagaaacgccagcacgaatcccatgccgaggagcatcagagtgaagccttcacctaatagcagagctgcattagtcataaaatagccttcaggcaggaggcacgataatggggctatttatgacgatgaaataataagggtggatttccctgagccgccccggccagagcccttggttattattatcgtcataacgtattaccaccattatcgtgcaatttacgtaatcaggtttatttgatgaaacttacgttctggcatatttcatcagcgacgatctctttacgctgattaaaaataattttgttctgttcaaacagattattcccatgggtatcaatagaaacaatcagcgggccaaactctttaacccgacagacccacagcgtttccggcatccccagatcgcgccattgggcatcttcaatttcttccacgcacacggcggctacaaccgcacaaccggcagggaatacgcagtgcagcgctttgtgttcagcacagccctcttcggtacctttacccataccgcctttacctacaattaatttcacgccagtctgcgcaataaactctttttcgaatttctccatacgcatgctggtggttgggccaacggagaccatttcaaacttatcgtcttcgcctttaattgggcggacaatggggccagcgtgtaaaatagcgccgccgcgaacatctaccggaagttcgcgaccaccttcaattaaacggcgatgggctacgtcacggcaggtaacaatatgaccgttgagataaataatatcgccagccttaatatccgctaaatcttcatctttaattggcgtagtcaggatttttttagtcatcagaaattcactccgctgtgagacgtaatggtgtaattcaaatctttatcgaaaacgatgtgccctttacggtgcgaccagcagccgacgtttaccgccacgccgatggtagaaggatgacgtgcggtgttttcaatgttcacgcccataacggaggtattaccggacatcccctgcggccccaggccaattttgttaatgccgtcttccagcattttttccagcgaggctgcacgctcattctcgttatgcgaaccgatcggacgcatcagcgcttttttcgatagcagtgccgccgtttcaacagaggtcgctacgcccacgccaaccagcagcggcggacaagcgttgaggccgtagctggtcatcacatccagtacaaagcgggtcacaccttcatagcctgcacccggcatcagcaccatcgctttccccggcagagaacaaccaccgcccgccatataggtataaatgctgcactgatcggaattgggaacgatttcccagaagaccgtcggcgtacctttacccacgtttttaccggtgttgtattcatcaaaagtttctacgctgttgtggcgcagcggagaatctacagttgctttgatcaccgcctcacgcaacaacgcttccagctcgccaatcagcggaaagttcgtcccgcactccaccaaaaactgaatgacaccggtgtcctggcaggaaggtcgatccagctctttcgccagacgctggttctcaatcatggtagtaaagatgacgtcggccagtttactggtctctttcttatgcaaatcttccagttttgcagtgacatcatcaggcaaaactttgccggtatatcccacaaacttggccataacgtcggtcatatgggatatctgttcacttttgctcataaatgctccttagtcagaacagcttccgttaattacggatgaaaagggaaaaggattggcagcaggatcaagctgacaatggttgaaacgataatcagggggataccggccttagcgtagtcgacaaatttatagccacccgcggagagcaccatcatgttggcaggcataccgataggagttgcgtaggcgcaggaaccgccaatgaccgtcgccatcagaaccgcacgcgggtcggcccccatacctgcggcaatggacaaactcaccggcaccaatagcgctgtcgttgcggtattggacataaagttggtcatcacaacggataaggcgaaaacggcgatcagcaacatgaacggtgaggagttttgccccagcatgccgattacatagtccgcaaccagcttgcctgccccggtcatttccagcgcttttgccagcgccagggtgccgccaaagataaaaatagtctgtgaatcaatggctttataggcctgtttttccgtgagtacgccgcttacgaccagcacaagagcgccaatacaaccggtcacggccaggctgacaccgatcttcttctcaaagatcatgccgaggatcgttgcgatcaacaccacgagtgagagccgttgtttccactgtggaacatggctgtagtcacgttgctccccgacgctccccacctcaccgccggtcgcattattcggcagaaagcgatagccaatagtcaggaagtagagaatgccgcagatgagcatcgggagaccgatttttgcgtattcaaaaaagccaaagccgccgccaatattctgtagcgcagactgcgcgataagatttcccggcgcgccaattaacgacaggttaccgcccaacgcagcggcgaaaaccagcggcatcagtagacgagaacgcgagaagcccgattttgccgccacgccgatcaccaccggaatcaaaaccgcagcggtaccggtgttagagaggacgccagacatcaaacccaccaccaccataatggtgaagatcagctgtttttctgttttcgcgaagcgcgtgatgacgccgcccactttgtttgccataccggtctcaaacaacgcaccgcccacgataaacatcgcgacaaagaggatgacgttagtgtcgataaagccagcaaaggcctgtttaatattcagaacgccggtgataactaaggccacgcagacaatcatggaagtgacggccagcggcactttttcccatacaaacatgacgatagcgaacaccaataaacatagggtaagggtaatgggttccatatttataattatccaatcaatgatatatgatattgtatccaatattgacgaggagaaattattcccatacaaaaaataagtcaaatcgtttctcaggaaagatgcaggagtgggatctacatcaagatcgtagttggatcgttactggacgtgattaatagaattgaagaattggttgaagcgcctgcgatactcacgcaggcgaaaagatcaggcagaagggtcaccaacatagcgggtcagcatattctccattgagcgaataatgtgttcgcgcatgcgctggcgtgccaatgtttcatcatgaagttcaagagcttgcagaatacttttatgttcctgaatggaaatcacggcatactcttcttcggtgaccttatggcccatcgacaggccgttccacatattacagagcaacattttcattttttcgttgccagcaacattccatatttccatatgaaatgcctgattcaggtcggagtattccgccgagttattttccgcgagagccttttcagcggcataatgcacctcggctatccgcgaaatatcggtgccaggacgagaagctttagccaccgcctcactttctaacagcgcgcgaatttcatagtgttcacggatcgtttgttcattgatgcccaacaccaccgcccctttattagggcgcacttttatcagcccatccgccgccagaatctgaaacgcctcgcgcactggcatactggacacgccgaccattccggcaatgccttctaacgtaatctcttgcccttccactaactccctcgaaagaatcgctttacgcagcaccgccgcgacctgttctttcgctgaaagaagcttaatcttccctaacttaggcctctgcactttcccaatccttcatatgttgacgcattatttctgctaaagagaggaaataacgctgcataacttgcccaatctcatcacgccgcccctggcgtatgacgtcagccagttcagcgaaaagctgcgccgactcctgattatcttttttcagatgcaaaataacataagagacataaccgtccaggaactgctgatacaccttttccagatagcggttattcacataagaaatcagcatcgcatgacactccagttcgcaggatttgtcttctgcgacagccagcgcttgcgcacgtatcaggagggcatcgcctacttcgctgggtatcagcgaaaacatttcggcggccatcgcggcaatcacgcgaaaaatatgactcacgcgatcggcctcaagatgcgcgacctgcatgtgcctgttgggcagtcggattaaaaaaccttcctgttcgagtgactgtagcgcttctcgaaccggcattcgtgaaagaccgagctgctccgcaatactttcctgcgcgagttcttctcccgcttttatattgccggaaagaatttcatagcgaagcatttgcgtaatgtgatcgcgggtttgcgttctttggatctttttcacgacgttctcgttaataaccgataagacgtgaggagtttagcagatttagtgcttgatttcgtggcttgtttatagttaaagaagccggagcaaaagccccggcatcgggcaggaacagcttatttattaataaaatcttcacccaactgaatatcttttttcagcgtatccagcatagcgtccagcgaatgttgctcgaaagtgctcagtgtgccgatggatttacgctcttctacgccgtttttacccagcagcagcggctgagagaagaaacgggcatactgaccgtcgccttccacataggcgcattccaccacgcctttttcgccctgcagagcgcgaaccagagaaagaccgaaacgcgcggcagcctggcccatagagagggttgccgatccgccgccggctttcgcctcgacgacttcagtaccggcgttctgaatacgtttagtcagctcggccgcttcttgttcggtaaaacttacgcctggaatctgcgatagcagcggcagaatcgtcacgccggagtgcccgccaatcaccggaacttcaacttccgttggcagcttacctttcagctctgcgacaaaggtattagagcggatgatatccagcgtggtaacgccaaacagtttgtttttgtcgtatacgcctgcttttttcaacacttccgccgcaatcgcaacggtggtgttcaccgggttggtgataatgcccacgcacgctttcgggcaggttttagcgatctgctgcaccaggtttttcacgatgccggcgttaacgttaaacaggtcggaacggtccatacccggcttacgcgccacacccgcagaaatcagtactacgtcagcgccttcaagcgccggggttgcgtcttcaccggagaaacctttgatttttacagcggtggggatgtggcttaaatcaacggccacaccgggagtcactggagcgatgtcgtacagggagagttctgaacctgaaggcagttggttttttaaaagtaatgccagcgcctgaccgataccaccagcagcgccgaggactgcgactttcatcctaaactccttattatatgattagctaagtgtctattgctccgcggcggcgaccttaattcacaaattcaatgattacaatcctcactcatcaagaatgcggagtcgcgcaattttggcttttatgcatttaatttgcgtaatccggatcggctgcaaccagagagcaacgttctacaggtggtgacaatataccctactaccctctcaaaacaacatcattttgataacaattaatttacttttaatcttatttgcgaggcgtgacacaggcatgtttcttgattacgaaatttgataaaattccgctctttcataacattatttcagccttaaacaaggcagactgtttgcataaaaattcatctgtatgcacaataatgttgtttctaccgccatattacgggtgacttatgcgaagctcggctaaacaagaagaactagtaagagcgtttaaagcgctcctcaaagaagaaaaattcagctcacagggcgaaatcgtcctcgcgttgcaggatcagggctttgaaaatatcaatcagtccaaggtctcgcgcatgttgactaagttcggcgcagtgcgtacacgtaacgcaaaaatggaaatggtgtactgtcttccggctgaactgggcgtcccaacaacatccagtccgttgaaaaatctggtgctggatatcgactataacgatgctgtcgtggtgattcataccagccccggcgcggcacaactcattgcgcgcctgctggattcactggggaaagcagaaggtattctcggcacgattgccggcgacgatactatcttcactacgcctgccagcggcttttccgtaagagatctgtacgaagccattctggaactttttgaacaagagctttagtcccacttcctccgtcgtcgtacggcggaggcatctttttgccctctcccctcgccgctttcctgtacggctatcatttggcaaatcatgcccttaaacattcaccacatgaatgaaaaatcaaaaaaacgcacaaaatgtcaatttttttaaccagttgattttcttttatttttcaaacgacagcggcgaaaaacagcaattttaattccataacgttataaaaaataaaatttttaatgtctttaaaaagcagaaacaattagcgtggtattaattaattgcgtgattagtgtatacttaattttgtgatgagggtcacgaaacaaagaccccagtaaaggaattcgacgaggtaaaaatcatgaaaatcaaaaccactgttgcaacattaagcattctgtccgttctctcttttggcgctttcgccgcagaacctatcagcgcagagcaagcgcaaaaccgtgaagcaatcggatcggtttcagtcagcgctatcggctcatcgcctatggatatgaatgccatgctgagcaaaaaagcagatgaacaaggcgctacggcctaccacattaccgaagcgcgtagcggcagcaactggcacgccactgccgaactgtacaaataaaattcacctgccatcgcatataacgtgtcgttacttcgcggagatatcgcataagaaaagcccattaatccgcgaggttgaccctataaaggaataaaagaccatgaaaacgaaatacattatcgcatcactcggcctggccactctgctctctttcggcgcaaatgccgcagtacaccaggttaacgcggaacaggcgcagaatctgcaaccgatgggcaccatttccgtctcgcagattggcagtacgccaatggatatgcgccaggagatcgtcgctaaagccgaaaaagcaggcgctaatagctatcgcatcatcgaattaaaagaaggtgataactggcacgccaccgccgagttgtataagtaaaccttcgtcgtctaacccgacgacttgcccccgcatgccgggggcttttttatgctttttcaatgccggacattaaaccgtagccgtccctccagctcttcttccgcttcatcaaagagtaaaatcagcgccccgtagcgcctgcgcagtttatcaggcaggtgaacgaactcaatctctagcggtaggggtaagatatcgctcattaccgcatcccataatgtatcaagatcgcttactttctcactggcaaggccaaacgtctgcgtaaactcgcgataaaaatcgctttggtttttaatatcattaaaatcaaatgtatagacattcatagccagccaccatccccgacagacaattgtctgttttactactaagcatcattatgcagaggtttcacttccagaaacgcttttagccccggagcactcttgcgctgtttttgtatctcaaataagtatagtcataaaaaaaccgacgcttttggcatcggttcttgtggattagctatcggtaagcgcgttctggtatttatgtaacatgcccgtcaggcgtttaaccggttccgtcacctgcggcggcgcctcccagatacgtaatttctcctgatagatatccagctcatccagcaactgaccaaagtagcgtcgccgtttatcatcgcttccggcggaaataacatggtctgcggtacgacgaagctggcggtggaacactgacagatcttcattaaccggtatcggcgcgtcgcgcagacgttgatgagcaatgatcatcgttagcgccaggcggaacttcggcaaatcgcctgggaatttattcatcagcaaaaagagttgctgatataacgcaggcagacggttttctttacggcgtaccacgttggtcgtcattgccgagaccgcagcggaaacaaactgattaagcagcacgcgaccggttcgatctttggatttatcacgcaccagcaggatgacgataaacgccagcatacagccgacaatttgccccaacgcgctgtcgaggaactggatgaaatggaacgtcatcggattatccaacacaataatgttaatcgtactggccagcgcccccatcgaccccagacgccgtttctgaacttcaataccgataaagaaccccaataccgccaggctcaaacataacaacagcatactttgctgcgtattgggaataatcaccaggaaatagagcaatcccagcggcaacgccgccagagtgccataaataaaatcaatgcagaccatgcgcggattgggtaaacgcatcgccagcgaggtcaccacggcaatcatcaccatcgcgccattacccgatgtccagccggtccatagccagaataatgtccccagaatgcaggaaagcgtggtgcgccagaagttcaccatcgcatggtggcgttcagcggattccactttaactacgggctcgccttgcaggatctcttcttccgtcgcgctgattttggtgttactgatcacgccgcgtttaagcaacagatagcgcgttgcagcgcctacccagctataaagcgtgacgggcgtttcgcgctcgccggtccaaacaatgacacgccgcatccgttttaactgcctgtggacgtcctgtaccgtttcaaccggcgtctcgaacagttcccggaatgtatcggtaatcagttccggccgcgtgttttgaataagataagtttcacaggattgcgtaatcagcgtgagcgaaagcgtattcaacgctttcaggcggcggttagcgcgtacccagcgcgaagattccatattcagattacttcgcatcccctccagcgccgccgtgcgtcgcaccagatcgccccaggcgttgtcgacttcttcgctgtcgccatgcttaatacaaagttgcattagctgatattgcgctaccaataaacagtccagttcgcgatcaacctcctgctttatcgatcgcggcgagaaaagcagatccgctaaaatagcgcagccaatgccgatgacgatttcgctacagcgctcaagcgcaaattgcggcgtaagcagcggctccgtctgaatggtaatcacaatgatcagcgcagtataacctgacagtccccacgcataagagttttcgatccgtactaaagaggagatccaggtacaaaaaccggcccagacacagcacaccagaatcatcaatagcggcgcgcggatcatagagataataatgataagcgcggcgatacagccaataaacgtcccgataatacgcaacattccgcgataacggatagcgccggaatagggttccccgccggcggcaaatgccgggcctgccgccacgatcgcggcggtcagcaccgcccaacgcggcgtctccagctgaaaatggaagccgataaataatgccagcacaatggcgcacgccagctttaccgcaaaacgaatgtgctggttggcaatggagaaaatgcccatgacgattaaccgaattcgcgcagccggtgcgccagtttacggaagaaggagtcctggcttgcgtcacgatcctgcttaccggtgatcacgacggttgccgtcgtaccggcaggccacaaattcccctgctgctcgtcgagccggatgcgcaccgggacacgctgggccagacgcacccattcgaggttagagtctatcgtcgccatccctttcgcatcgctggtactgctggcattcgttacccctgccgccacgctatcgacggtgccttttaatacccggttgctgccgagcggcgtgatttcggcacgatatcccggacgcacgccttccagcttggtctcttccatataggcctgcacgtaaaaagagttctttttcaccagggcgacggctgtggaaccgcgggtaataaattcaccggcataaacattgaggttagttacccagccgtctgcaggcgcacgaatgacggtacgctccagatcgagtttagccagatcgcgcgtcgcctgggctttagccaattgatgcagtaccgtctgcaagacgttgttcgcctgatcgatctcttcccgggacatcgcctgtacgccgaggcgattacggcgaccggcttcctggcgtttttcctgcgccagtacctgataataggctacatcagcttccgcttccgccagcgctttttgatagcgtggctgatcgatggtaaacaggacctgatcctttttcaccagttggttatcatgcacgtttacatgggtaatcaggcccgcgacatccggggcaatagcgacgacatcggcgctaaaacgcgcgtcgcgcgtccagggtgattcggtgtaatacacccaggcgcggaaaatggcgataaaggccagaataaccagtacgagggtaatggccgtacgggagagttttcttgttagtgttttcacttcaacctcaaacgaacaggcgcgatattaaataaaacagacaacaatacagcgcggtattgaacagagccggatgccagacaaaatcatagatgcccgtcggcacaagcatccgacgcaccagccaaaaaatagccagtgacaaaagcaattcgaaaaatatcggtgggaaggaaagaccaaacaccacgataacgggaaacagactcatgttgaccttgatttctgagagagagcaggcgatagattgttaagctacatcgccgcagagaagggcaagagacgccaggcgagagcgacatagctcttattcgaataatagtatattaacgtaattgttatgctgttatctatattatgtgatctaaatcacttttaagccagagtgaataatggaacgattaaaacgaatgtcggtattcgccaaagttgttgagtttggctcttttaccgccgcagccagacagctgcaaatgagcgtatcgtccatcagccagactgtggcgaaactggaagatgagcttcaggttaaattgctcaaccgcagcacacgcagcattgggctcaccgaagctggaaaaatctattatcagggctgtcgtcgtatgctgcatgaagtgcaggatgttcacgagcagctttacgcttttaataacacgcctatcggtacattgcgtatcggctgttcttcaaccatggcgcaaaatgtgctggccgggcttaccgcaaaattattaaaagagtatcccggtctggcggtcaatctggtgacaggaattccggccccggatttaattgccgacgggctggacgtggtgatccgcgtgggcgcgctgcaagactccagcctgttttcccgtcgactcggcgcgatgccgatggttgtgtgcgccgccaagccctacctcgctcagtacggcgtcccggaaaaacccgccgatctcagtagccattcctggctggaatatagcgtgcgcccggataatgagtttgaacttattgcgccggaaggaatttctacccgactgattccacaggggcggttcgtcactaacgatccgatgacgctggtacgctggctgaccgccggaaccggaatcgcctatgtgccgctgatgtgggtgatcgatgagatcaatcgtggcgatctggagatcctgctgcctcgctatcagtccgatccccgtccggtgtacgcgctgtacaccgaaaaagataagctgccgcttaaagtgcaggtagtgattaacgcgttaactgactattttgtcgatgtcgcacacctgtttcaggggatgcacgggcgagggaaagaaaaataaaaacaccgggtaattgctgaagacgattgtagatcagatgccacccgaggcagacattgcctgatggcgctgcgcttatcaggcctgggcggcacataccacaggcctgataaggcggacagttatgcggtgccgccaaccgtcaggttatcgactttcagcgtcggctggcctacgcctaccggcaggctttggccctctttaccgcagacccccaccccgttatccagcttaaggtcgttgccgaccatggagatctgttgcatcgtttcaatgcctgatccaatcaacgtcgcgcccttcaccggcgtcgtgactttgccgttttcaatcagatacgcttccgaggtagagaacacaaacttgccggaggtgatatccacctgaccgccgccaaagttaggcgcatagatgccatactcaacggattcgataatttcctgcggcgttgactgccccgccaacatataagtattcgtcatacgcggcatcggcagatgcgcataagattcgcgacgcccgttaccggtcggcgcagcgcccatcaggcgcgcgttcagcttgtcctgcatgtatcctttcagcacgccattttcaatcaatacgttgtactggcctggcgtaccttcatcatcgatagcaacggagccacgacggttcatcattgtgccgtcatccactacggtgcaaagcgcggaggcaacctgctcaccgatctgaccgctaaacacagacgtcccacgacggttgaaatcaccttccagcccgtgcccgaccgcttcgtgcagcaatacgcccggccacccggcgcccagaaccaccggtaacgtccccgctggcgcagcgaccgcggagagattaaccagcgccatgcgtaccgcttctttcgcccacgcgtcggcgcgcacctcgccgtcaagatcggcaagaaaatactcataaccaaagcgaccgccgccgccgctggcgccgcgctcgcgtttaccgtcttcttccacctgcacgctaacggacaaacgcaccagtggacggacatccgccgccagcgtcccgtcggtcgccgccacgaggattaattcatatacgccggtcaggctggcgttaacttcctgcacgcgtttatcggcttctcgcgccgctttatcaacgcgtctgaggatatccagcttctcttcgcggctcatactttgcagcggatcaagggtggtgtagagcggctgatgcgctacggcggcgagcgtttttaccttgccttcgccgttctcgcgtacaatggttcgcgctgcctgcgcactctgctccagcgcaaggaggcttatctggtcagcataagcaaaaccggttttttcgccgctaatggcgcgaacgccaacgccctggtcgatattatatgaaccatctttaatgatgcggtcttctaaaacccaggattcgtgatagctcgactgaaaatagaggtcgccataatcaagacggcgttcggccagttggcccaaaatagcgaacagatcctgatggttcaggccattcgccgctagcaattgttcacttaccaggttcagactcatcgtttttgctactcgttgatttctgccggatggcggttcacgccttatccggactacgttgttagattgtgcaaaccggataaacgcagcgccgtccggcatgactatttactgagagtggggcaattcctcgcccccgtcaaatcattgctggctttcttttctcggttggcgcagaacttcgttgatctgcggcgcatcgaccggaccggtaatgcgataacgcagaatggagaccttgctccatagcggccccaacactttactggcggcaaataccgccgcgccgacaatcgggttaacggcaaacgcggcagcgacgcccacggtggcggaaatttccgccgcgacaacggcctccatatcaagacgacgacgcaccagatcaacagaacctttcattgcaatatccgcttccagcccatccaccagcgtatcgtcagtatgcaggacgccatctttaatccacgcggtactatgaatagagtcgaaatagaagccctcgctaaaggtatctctgaagtcaaaccgcagcttacgcagcaacgcatcaaaactgagcagccgcagtagctgtccggcatgaccgctactgagatcagtaaactcgcctttgcccagacgcgtacgtaaaatcccgttgagcgtggcttcctcaggttgccagggcgggtttcgccagtgcagatcgtaatctacgttaaaagacgcgttctggattggcgtcgagatgccgaagaacccggcagccgtgtcgaggttactaccatgcagactacctttcagcgaggttcgttcattacccggcgcattcacccactcgccgttcgctttcaaacgggcgaatccggtatcgatcaggccattcgccagagtcagcgtattgcctttgatggcgaaatcgccatcaatacgcccatatttttgcccccatagccagcactcttcgcagcgaagctgtaagtccggccagccgcggaagctaatcgtgttcgccgaagccaacggcgatgtcggcgttggtgacgaggcgtgcgtttttgcgacgccagggttgtagtacaggtacttaatgttcgccagccacggcgcatggttgcgcatgagtagcgtggcgttcacctcacggccctgcgcttcaatttttgttccgttcagcgagggggctgaaacgacgctcaaattgttccactgctggccgcccagcgatagcgcgggagtacgcaacgtgacgcgttgaggaaactcggccgaactgctcacgttatccgccgcgcctttctggaataacgccagccattgcgcgccatccagcgccggcagattgagctcaacgccttgttgagcaggtaatggcggaatcgtccggctgtccgtcgtccagatagcccgatccaacgtcagcttctgatttaataaccagcggctgttaaagtgatttttactccctgcgctccccgttagcgcaaaacttttcaggttgccgtcagcctgaatgttcaccggaatggcttcgcctgcgggtttatttagcggagaaggtaagtgactgctcacatttctcagatcgccgttcagctcgatgtgataagtggtgtcagcgtgatatggaagatcgatgccgactttaccattccacgtcacgctgccgctcagggcgtcattcagttgcggcggtaagacgcccatacgcgttggctgccagttaccgttcaggttgacggcgacctgataggcttttgccccttccgtcgtactgaaatccaggttaagcggctgattaaaccagtttgccgtcagtggcccgctttttagcgcgccattcacaaagctgaatttaccgttcagatttttgagcgtgctgtttagcggcttaataaacagactgttattacgcaacgagacatcgccctcggcggtaacctgttctccgtccagcggaatatcaagatgtaagcgagcattcacatcgccatctaattggagctccgccagcgtcgagccaagcgagtcttttagcggcgtctcgtcaaaataaggcccaacggcttttcccggcccgttaatatcggcatcaatgagcagtttctctttggaataatccggaatcgccgccgcgagtttgctggccttcaccccgcccaaatcgacgctatccgaacgcatccacaggccgtcgttcaggaaatccagttcaatgttgagattttttagcgccggccagtcgggttgaaaagcaaacgtcgcattgcgtagcggcaccagcacttcaaactgaccttcgttatgcttatagggaaagaggtgcgggttaccaccgtaaaccaacgtggcgttatccgcctcgccgccctgaatcgcgccgctaaggtaatcgactagcgctttgcccatcaggttttccggaaaatagcgccacgcctgagatccatcatcggtactgattccggccagaatacccagccacggttcgtcgcccgtcggttgcagatagcggaacccgccgcgcgcatgtaccgcctttgctttgacgtcaatgtcgcggccatcaagctgaaagccgttctcattcttcaaccagctaagcgtcgcgacgccgttttcaatttccagcggcgcgcgaaaaacggtttcatagggcatcttagcctgctgcatcgcaaccttcatctgcccgtcttctacgcttcccgccagcgtaccggaaaaatgttccgcgccgggcaacagcttccactgtttccaggcaagattttcccacgatgcctgaaaacgcgttttttcggtcgcctgtagcggaatatccagcgccagtgtggcgatctttccgctcggctgcgtagcctgccatatttcgcccagcacaggcgacagtttagccgccagcggacgtaatgcttccagccccgccagttcaagattactggcgcgaatgcgtagctcatcgctacgtgtgtgattctcgccgccgacgtcctgctgcgggagccaggccacggttaaggctccgctcggccagggtttgccatcaagcgtaatccgtgtgtccggaatataaaactgccagcccggctgctcgcggctaatctgcgccgtcaggttatcgacagacaacgtatgcgtcgtgttatcgcccagccagcttgcgccgccctgtttcagccagacgtcccctccggcgatttcgcctttactgagcgtcatccagccttccagactgaaacgcgccgtctggagcgccacattatcctgcatccatttgcccagccacggcttgacgtcaatatcgtcggcctgtaaccagactctgccgttatttagcagaccgtcgtcatcgcgtaaatccatccgcacctgcatcacgccgtgctgcccggtcaggctggagaggctgacctcgccttcggctcggtgccgctctttgccgtttagccaggtaagttgtgggatcgccagttccgcgcgttgtcctgaaagcgtcagaaaactgatttggctatcgcgcagatcgaaatgatcgaactgccgcaggaaaagatcgcttaaacggctggtttcgatgccttcgccgtcgctgctttgaagaggcgtgttggtgcggaaattgagttgccagaaggtcaggtcgcgaaactgccagcgcatgtgcaacaggctttgccagacgtccagcgccagcgtaacgcgttttatcgacagctcgccgccatctttcagggcggcatgaatattatgcgcttccagcgtagggccaaaattttgccagcttgcggagagttggctggcggccaccggcacgccggtcacggactcaattttattcaggatagctggacgccaggcgtcaagatgaggcaacgccaggcgcagcccgctaaccagcagcgctgcaatgacgatgagcgcggctccagtgagcaataaaatccccggcaatcgcctcacgcgtctctccttgtctgccaaaaaatacgactcaccccccttgagggtatattgccggatggcggcgcttgcgccttatccggcctacatgcgctggtgctattactcaattacatcattacgacgtcaaactgctcctggttataaagcggttcgacctgaactttaacctgtttgccgacaaagatttcgacttccgccagcgcgtgtgattcttcgcctttcagcgcttccgccaccgcaggagaagcataaaccaggaagcgatcggagtcataagcgtgatgaacacgtacaatttcacgcatgatctcatagcagacggtttccaccgtttttaccgtcccgcggccatgacaggttggacactcgttacaaagcacatgttccacgctttcacgggtccgtttacgggtcatttccaccagtcccagcggcgaaaaaccgttaatactggttttcacgcgatccttacttaacgcctgttccagcgaatgcagcacccggcggcgatgatcttcattattcatgtcgataaaatcgataatgataatgccgcccagattacgcaggcgtagctggcgggcaatggcctgcgtcgcttcaatattggtattaaaaatggtgtcgtcgagattacggtgtccgacaaacgcgccggtattgatatctaccgtcgtcatcgcttcggtttggtcgataatcagataaccgccagacttgagttcaactttacgctccagcgcgcgctggatttcattttccacgtcataaagatcgaagatcggctgatggccactgtaatgctccagcttactggtcatttccgggatgtattctgcggtaaactccagcagcgactcataggtcagacgtgagtcgacgcgaattcggtccaactgcgcatcggcgaaatcgcgcagcacgcgctgcgccagcgccagttcgccatacatctggtagcgcgtttgcggacgctttttgcgctccatgactttcgtccagacgcgcttgagataggcggcgtcagacgcgagatcctcttcacacacgccttccgccgcggtacggataataaacccgccctgttcgtcgcagtattccgccaccacctttttcaggcgctcgcgttcactttcgctttcgatgcgctgggaaacgccaacgtgtgacgcgccgggcataaaaacaaggtaacgggagggcaacgtgatgtccgtggtcaaacgcgcgcctttcgtgccgagcggatctttcactacctgcaccatcagatcctgtccctgacgcaccagttcggagatatcgcgcacggtaaactgtttttgctcgtcgcccgccacgcattcggtatgcggcataatgtcggaagcgtgaagaaatgcggctttatccagcccaatatctacaaaagccgcctgcatacctggaagtacacgacttacacgacctttgtagatattgcctacgattccgcgtcgcgcttcgcgctcaatatggatttcctgaagaataccgccatcaatgtacgccacgcgcgtttccgatggcgttacgtttaccaacaattcagccgtcatgtttatcccttttatcacgcagtgcgttaaaatgactcaacaactcatacgtttcaaccagcggtaagccgaccacggcgtgatagctgccatttatcttcctgacaaaacagccaccccgcccctgaataccgtatgcacctgctttatctaaaggctcgccgctggcgacatagccagtaatatcctgcgcagaaagcgtgcggaaagtcacctccgttaccaccagacaatccagcgtctgctgcgagtccgcaagcgcaacagcagtcatcacctgatgcgtatttccggaaagcaaacgcagcatttctgcggcatgagcggcgtcgcgcggcttttccagcacctcgccgtttaacacgactatcgtatccgcgcccaacaccggcagatcacggggaaccagcgccacgccagcctgcgccttttcgcgcgccagccgaacaacatactgctgcgcgctttcctgaacacgccgttgctcttcaataccaggcacgacctgctcgaatgaaaatccaagttgaatcaataattcctggcgacgcggggaaccggaagcaagatacagagttgtcatatcgacctttattgcacagcaaactgctggcgtactttacgcatcagcaaaaagagccagggccacagcacgccattgactacactactccagaacacttccggtctgaaagagacgttgatcactaaaaactcggcccagaaaacaataatgtccacggccagtgaaagcaacattaccaccagcgcctgctgccagagcgccaggttacggaagagctggaatttcagagcgaccagataggcgacaatgctcatcgacagagcgcgcacgccaagtgtggaaccgctgatgagatcaagtatggcacccatcacaaatcccgtccccacatttacgcggtgcggcagggccagaatccagtacagtaagatgagcaaaacccagtttggccggaaaacaatgatgtcgtccggccagggcatgatttgcagcaacagcgcaataagaaacgagagccagataacccagcgcccctggctacgatagctcgccaccattaccctcccggcgcacgcgcagacggcgtggtcgcgcccgaaggcgatgattgcgttgataccggcgtagtctggcccgcagatggctgagtaatccccgtcgccgggtccggcactggcgccggcggccccatcgcatccggagaaggtaacacctgcggcatcatctgcatcaggcgctcattggcgacgcggtgaacctcttccggcgtcatcggattggcgccgttacgatcggctccccacaacagcagcagatagcgtaaacgctgcaaacccgcggttggacgagcctgaatgacggtataggcgcgctgagtgtccagcttgacggaggagaccaccgccaccggatacccttccgggaaacgcccaccaagtccggacgttaccagcacatcgccaacgcgaatatcggtattggcgggcagatgttcaagctgaagatcgtcagtgcagccgttaccggcggcaatcacgcggatgtcattgcgtagtacctgaatcggcagagcatgagtcgcatcgcaaatcagcaatacgcggctggtcagtttcgccacggcgacaacctgccctacgacacctttgtcgctaatgaccggttgaccttcatatacgccattaacgctgcctttatcgataacgacctgatcgctgtaaggatcgttaaccgttgaaataacctgcgtcaccattttctgctcgtcctgacgcagcggcgaccccagcagctcgcgcaaccgcgcgttctcctgtttgtactgccccagcatcagcaggtcgctgttttttagcagtaattcctggcgcagcgcccggttttccagctcaagctggtcgcgagaagccagcgtttgcgacacgctgtcgagcagttcacgagggccgtttgaaataaaatagaaaggactgacggcagtgtccatgtacgttcggatttgactgaacgtccccaggcggctgtcggcaatgataacgccgagcgccaccagcaccgccagaataaggcgaatctgtagcgacgggccacggctaaaaattggcttcataggctatgcgtattctcgcgtcggagaggcaggacaatccagggataatcctgcccgtatccaactactcttcgctgaacaggtcgccgccgtgcatatcgatcatttccagcgccttgccgccgccgcgcgccacacaggtcagcggatcttcagcaaccacgacaggaatgcccgtctcttccattaacagacggtcaaggttacgcagcagcgcgccgccgccggtgagcaccataccgcgctcggagatgtctgacgccagctccggcggacactgttccagcgccaccattaccgcgctgacgataccggtcaacggttcctgcaacgcttccagaatctcgtttgagttcagggtaaagccgcgtggaacgccttccgccaggttacggccacgcacttcgatctcgcggacttcgtcgcccggataagcggaaccgatttcgtgtttaatacgttctgcggtggcttcaccaatcagagaaccgtagttacgacgaacgtaattaatgatggcttcgtcgaagcggtcaccaccaatacggacagaagaagagtaaaccacgccgttcagggagatcacggcaacttcagtggtaccaccaccgatatccacaaccattgaaccggttgcttcagaaactggcagacctgcgccgatcgcggccgccatcggctcttcgatcaaaaagacttcacgggcgcctgcgccctgagcggattcacgaatcgcgcggcgttctacctgcgtcgcgccgaccggcacgcataccagtacgcgcgggcttgggcgcataaagctgttgctgtgcacttgtttaataaagtgctggagcattttttcggtcacaaagaagtcagcgataacgccatctttcatcggacggatcgcagcgatattgcccggcgtacggcccagcatctgcttcgcatcatgaccgactgcagccacgcttttcggcgaaccggcacgatcctgacgaatggccacaacggaaggctcattcaatacgatgccttgtccttttacataaatgagggtattcgcggtacccaggtcaatggacaggtcattggaaaacatgccacgaaattttttcaacatactaagggataatcctgaaagctggggcggaaaacaaaatccgcttactttaccaaccacacgcagcagcgacaaggcgcaaaaatcatctgctacggtgaaaattagtgcagttcgtttcctttgttacaaatctcggcctgagtccctcagggctgaaaaaatcagcagcaatcctcgccttcgtttgcaacctgtcaaaggtcattcacctgcatatttgctgcaacaatctggcgagcagacaagcacacccccatgaggcgcagcgcgcgttattctacgtgaaaacaaattaaacggcaggttaaaccgagtatctttgcgaatattttttcacgtttgtgtcaagtagttgggaggaggcaaaaaaatcaccctgcccgccagccacgccgcgttttgtcagcgtctgccactcgccgcgcgaacggacgcccgtcgcgtaaacctgcgtaggcgtgcccgcgcaggcctctaccagactttgaaccagaagctggttttccgttcgcttctcaatgtttctgaccagactcggatgcagcttgagtaattccacattgagcgctttaatccagctcgtgctaaccagcgtcaaacccgcctgtgtcaccgccacccgaacgccaagcgcattgactaagcgaaggatgggttgtaaccggctgatgtgttgacaaacatctgcctccgcaagttcaataattatgcgatttcgctgtgatttttcacactgcattaacgtatcgcgcaaccagcgctgaaaacgcggacgaatcagcgactcaaccgtcaactgcattgccagattttcatccggccagtagcccagcaacgtaatcaggcggctaatttgtaatctgtcatactcttccgataaaccaaattgcaacaccatcggcatatactccgccgagctcacctcttctttaccgtcatagatgcgacacatcaattcccgatgatgtacgcgaccttctcgcgtgaccgccggtttttgataaagtcgcggtccgccccggttcagcatctgctcaatcaatgtgcgccagcgcacattgccgcgccctttttccggcagagtgtcgtcgtagatagcccagctatttcccccctgcagggcggcattccgcgccgcggcttcagcatgttccatcacctgatcggtggactgtccgctgcgccaggcgcaaatgccgatatgtaccatatcgtcacgatcgagcattttgttagccggtagcgcatcgacagcttttaaaagttgtccggcaatactttccgcttctttcagcgttcgatgcggtagcagcacggcaaagtcgctgcggtgataacgcgccagcagcgagcctgggtaacgcataatgaatgtcgatagcagattgataagcataaacatctgctcttccgcctgattgcctcccaggctgtcgcgcagaagattgaagtctggcaagcggatcatcatcaccacgccatgcactcccactttttcctgatcttccagcagcgtcgccagctggttatcaaagaacagacggttaccgagtccggttttggtgtcctgcgcggcgtaggagcgaatgagggtgtccaggcgactacgctgttcgtgagcaaactgaatttcggaaagcaatacatcaagcgcgctactggtgcgcgctggccattcgtaaacagaaccgcggacattcgccccgcgttcgccgttcagaatacgcgttgagcgaatttccagaagctcctgcccggaaagctgccgctgcagccagcgcaccgataaaaacaaaatcagaacgataaaaccgatcgccagcgtcagcggcgccgtggtgatcagtgagtgaaaataattacccatcgggtcctgataaaccagacgtagcgacattcctggatgttttatcagcggtacgaccagctcgcgatacatgtcgctggtgccggctggccgataacctctggcgcgagaatggctgtagacgctgcgctccccctgcaacagatcgacacgcacaatatcggaagcgatcatgagctcgtcgatttgcggcgtcagcgagacaatatcatgggtcaccaggtgcgtatcaatggctgttgccgtcgcctgcacacggctgacatacttatactgtacggcgttataaaagcttagcgagcaacctatcagagtcacgaagatcgttaatcccgtgagcagcgtgataaaagctgagaatttcgtcgttaatcgcatccttgagttaactccgacggttataaacagtatgaaaaagcgaatctgaaggcggaattcgccacggcgcgcaatgaagcaggcatactaccaaaatggatctatctggcaatttattgcgttgcatcggcatcacgttttaattagcgagtatagtcttcgtagctatttttccaatctaccatgtaaagtgaggacaggttatgcaggcgttgatcttagaacagcaggacggtaaaaccctcgcatccgtgcaacatctcgaagagagtcaactgccggcaggtgatgtgacggtggatgtccactggtccagcctgaattataaagatgctctggctatcaccggaaaagggaaaattatccgtcattttccgatgattcctggtattgatttcgccggcaccgttcacgcaagcgaagatcctcgctttcatgcaggccaggaagtactactgactggctggggcgtgggcgaaaaccactggggcggcctggccgaacgcgcacgcgttaaaggcgactggctggtcgcgctgcctgcgggactgagcagccgtaacgccatgatcatcggcaccgccggttttaccgccatgctgtgcgtcatggcgcttgaagatgcaggtattcgcccgcaagacggtgaggttgtcgtcaccggcgccagcggcggtgtgggcagcactgccgttgcattactgcataagctgggctatcaggttgcagcagtatcaggacgtgaaagcacccacggctatcttaagagcctgggagctaaccgtattctcagccgcgatgagtttgctgaatctcgcccgttggaaaaacagctgtgggccggtgcaattgataccgttggcgataaagtgctggcgaaagtcctggcacagatgaactatggcggttgcgtggccgcctgcggcctggcgggcggcttcgcgctgccgaccaccgttatgccattcattctgcgtaatgtgcgtttgcaaggggtggactcggtgatgaccccaccggcacgtcgcgcagaagcctgggcgcgtttggttaaggatctgccggaatcgttctatgctcaggccgccacagagattacgctggcggatgcgccgaagttcgccgatgccatcatcaataatcaggttcagggccgtacgctggtgaagataaaataacgtcacgtataaaaaaatttacacttaattacctatttatttttacacattgacacactccctattatattcactacacgccatgttgtggtgggtagaccgggagtctgtgatgaaaaagatacgtccattaacagaagccgatgtgactgcggaatcggctttttttatgcagcgccgacaggtgctaaaagcattaggcatcagcgcggccgccttatccttaccctcaacggcgcaggccgatctcttcagttggtttaaaggcaacgatcgtccgaaagcgcctgccggtaaaccgcttgagtttagtcagcctgccgcctggcgaagcgatttagcgttaacgccggaagataaggtgacgggctacaacaatttctatgagtttggccttgataaagccgacccggcggccaatgccggaagtctgaaaaccgaaccgtggacgttgaaaatcagcggggaagtcgcgaaaccatttacgctggattacgacgatttaacacatcgttttccattagaagagcgtatctatcgaatgcgctgcgtcgaagcgtggtccatggtcgtgccgtggattggtttccctttatataagctactcgcgcaggcacagcccaccagccacgctaaatatgtggcattcgaaacactatacgcgccggatgatatgccaggacagaaagatcgctttattggcggcggactgaaatacccttatgtcgaagggctacgtctggacgaagccatgcatccgctgacgctgatgaccgttggcgtctatggtaaagcgttacccccgcaaaacggcgcgcccattcgcctcatcgttccatggaagtatggttttaaaggtattaaatctattgttagcattaaactcacccgcgaacgtccgccaaccacctggaatttgtcggctcccaacgaatatggtttttatgccaatgtgaacccgcatgtggatcatccacgctggtctcaggctaccgaacgctttattggttcaggcggtatccttgatgtgcaaaggcagccgacgctgctgtttaacggctacgccaatgaagtcgcttcgctgtatcgcggtctcaatttgcgggagaatttttaagtgcgtctgacagtaaaacagataacctggctaaaagtttgtctgcatcttgccggttttttgccgcttctgtggctcttttgggcgataaatcacggtggactcagcgcagacccggtaaaggatatccaacactttaccggtagaaccgcgctcaaatttttgctcgccaccttgctggtttcaccgctggcgcgctacgctaaacagccattattgatacgcacacgccgcctgttaggattatggtgtttcgtttgggcgacactgcatttaaccagctatgccttgctggaactggggatacataacctggcgctgttaggaagcgagttgatttcacgcccttatttgacgcttgggatcattagctggctggtgttattggcgctgacgttgacctcaacgcaatttgcgcagcgtaaattgggcaaacgctggcaaacactgcataacgtcgtctatcttgtcgcgatcctggctcccatacattacctgtggtcggtaaagattttatcaccgcaaccggtcatctacgcggcattagcgttagcccttttagcgttgcgttaccggaagtttcgccagtggtggcgctagtttggtgaactgtgcggtcgattgcaaaacgcaaaacaggtaatgtcctttttatgtttcgggttgattatcttccctgataagaccagtatttagctgccaattgcgacgaaatagttataatgtgcgactttacattccccaacggcgattttcgttcgcagataagggtgacaatcgtgcaatgaaggtatattttgttttttgcccgaaaatggcagaagatagccacacaatgactggcaaatcatgaatttcaccttcgggtgctacggcataacaggcaaatcaaagatgcgcggtattttacccgcggcagtcattcacatgctttacagacggcgctaaaacgcctgtcacaatcacactaaacaaagagtacggaacccactcatggatattcgtaagattaaaaaactgatcgagctggttgaagaatcaggtatctccgaactggaaatttctgaaggcgaagaatctgttcgcatcagccgcacaacggcaaacgccggtttcccggtgatgcagcaggcttatgcggcgccgatgatgcagcaacccgctctgtctaacgctgtcgcgccagcggctactccagcaatggaagcgcctgccgcagcggaaatcagtggtcacatcgtacgctccccaatggttggtactttctaccgcaccccaagcccggacgcgaaagcgttcatcgaagtgggccagaaagtgaacgtgggcgataccctgtgcatcgttgaagccatgaaaatgatgaaccagatcgaagcagacaaagcaggcactgtgaaagcgattctggtcgaaagtggtcaaccggtagaatttgacgagccactggtcgtcatcgagtaacgaggcgaacatgttggataaaattgtcatcgccaaccgcggcgagatcgcactacgtattcttcgagcctgtaaagaactcggcatcaagaccgtcgctgtgcactcaagcgcggatcgcgatttaaaacacgtattgctggcggatgagacggtctgtattggcccggcaccgtccgtaaaaagttatctgaacatcccggctatcattagcgccgctgaaatcaccggcgcggtggcaatccacccgggttacggcttcctttctgagaacgccaattttgccgagcaggttgaacgctccggctttatctttatcggcccgaaagcggacaccatccgcctgatgggcgataaagtgtccgcgattaccgcgatgaaaaaagcgggcgtgccgaccgtaccaggatctgacggcccactgggcgacgatatgaatgcgaaccgcgctcatgccaaacgtattggctatccggtgatcatcaaagcgtccggcggcggcggcggccgcggtatgcgcgtggttcgtagcgatgctgaactggcgcagtccatctccatgactaaagcggaagcgaaagcagctttcagcaacgacatggtatacatggaaaaatacctggaaaatccacgccacatcgaaattcaggtgctggcggacggccagggcaacgctatctatctggcggaacgcgactgctccatgcagcgtcgccaccagaaagtggttgaagaagccccggcgccaggcattacgccggaactgcgtcgctatatcggcgaacgctgcgcgaaagcgtgcgtagacatcggctatcgcggcgcaggaacgttcgaattcctgttcgaaaacggcgagttctatttcatcgaaatgaacacccgtattcaggttgaacacccggtaactgaaatgattaccggcgtcgatttgatcaaagagcagttgcgcatcgcggcgggtcagccactgtcgatcacacaggacgaagttgtcgttcgaggccatgcggtagaatgccgtatcaatgccgaagatccgaacaccttcctgccaagccctggcaaaatcacgcgcttccatgcgcctggcggctttggcgttcgctgggaatctcatatctacgcgggctacacggtgccgccgtactatgattccatgatcggcaaactcatctgctacggtgaaaaccgcgacgtggcgattgcccgtatgaaaaatgccctgcaggaactgattatcgatggtatcaaaaccaatatcgatctgcagacccgcatcatgaatgacgagcacttccagcacggtggaaccaacatccactatctggagaaaaaactcggtcttcaggaaaagtaatcgcacgttaatctcaaaaggccggtgaatccggccttttttatttctggggatagcgatgccccatcatgtacaattcccgctttcttcacccataagggacaaaaaatggacgctcgttttgttcaggcccataaagaggcgcgctgggcgctgtggctgaccctttgctatctggcggcatggttagtggctgcttacttatctggagactcgccgggaattaccggtctgccgcactggttcgagatggcctgcttattgacgccgctggtctttattttgctgtgctgggcgatggtgaaattcatttatcgcgatattccgctggaggatgacgatgcagcttgaggtcattctaccgctggtagcctatctggtcgtggtcttcggggtctcgatttacgctatgcgcaagcgtaccgccggcacctttttaaacgagtattttcttggcagtcgttcgatgggcgggatcgtgctcgcgatgacgctgaccgccacctatattagcgccagttcatttatcggcggtcccggcgcggcttataaatatggtctgggctgggtcttgctggcgatgatccagcttcccgccgtctggctttcactgggtattctgggtaaaaaattcgctatcctggcgcgtcgctataatgccgtcacgcttaacgatatgctattcgctcgttaccaaagccgcctgctggtgtggttagcaagcctgagtttattggtcgcgtttattggcgcaatgaccgtacaatttatcggcggcgcgcgactactggaaaccgcggcgggaattccctacgaaaccggcctgctaatatttggcgtcagtatcgcactctatacggcgtttggcggctttcgcgccagcgtacttaacgatacgctacagggcctggtgatgctggtcggcacgatagtgctgctggtgggcgtggtgcatgcggcgggcggtttacatcaggccgttgacacgctgcacgctctcgaccccaaactggtaacgccgcagggcgccgatgacatactttctcccgcttttatgacctctttttgggtactggtctgttttggcgtgattggcctgccgcatacggcagtgcgctgcatttcttataaagacagtaaagcggtacaccggggcattattatcggtacgattgtcgtggcgattttaatgttcgggatgcaccttgccggcgcgctgggtcgcgcggtgcttccggatctgacggtgccggatctggtgatcccaacgctaatggtgaaagttttgccgccgtttgccgccgggatcttccttgctgcgccaatggcggcgatcatgtcaacaattaacgcccaactgctgcaaagttccgcgacgatcattaaagatctctatctcaacctgcgtcccgatcagatgcaaaatgagatccggctgaagcgtatgtcggcagcgattacattactgttaggcgcgctgttgctgctggccgcgtggaaaccgccagagatgatcatttggctcaacctgctggcgtttggcggcctggaagcggtgttcttatggccgctggtactgggcctttactgggagcgggcaaacgcggcaggcgcgttaagcgccatgatcgtgggcggcgtgctatatgccctgcttgccacatttaatattcagtacctgggctttcatccgattgtgcccgcgttactgttaagtttattggcttttctgatcggaaaccgattcggctcttccgcttcgcaagccaccgtattgtctactgataaataaagagttttgccatgccatggatccaattgaaactgaataccaccggcgcgaatgctgaagagctaagtgatgcgctgatggaagcgggcgccgtttccattacctttcaggatacacacgatacgccggtttttgagccgttgccgggcgaaacccgtctgtggggcgataccgatgtgatcggtctgttcgacgccgaaacagacatgaaagacgttgtcgcgattctggagcaacatccactgctgggtgccggatttgcccataaaatcgaacaactggaagataaagactgggaacgcgaatggatggataatttccatccgatgcgttttggcgagcgtctgtggatttgtcccagctggcgtgacattccggacgagaatgccgtcaacgtgatgctcgacccgggactggcgttcggtacgggtacgcaccccaccacctctttatgtctgcaatggctggacgggctcgatctcaacggcaaaaccgtgatcgactttggctgcggttcaggcattctggcgattgccgcgctgaagctgggagcggcaaaggcgattggtattgatatcgatccgcaagctattcaggccagtcgcgataatgccgaacgtaacggcgtgtctgaccggctggagctgtacctgccgaaagaccagccagaagccatgaaagccgacgtggtcgtcgctaacatcctggcaggcccattacgcgaactggccccgttaatcagcgtactgcccgttgagggcggtctgctggggctttcaggtattctcgccagccaggcggaaagcgtctgtgatgcttacgccgagcttttcactctcgacccggtcgtcgaaaaagaagagtggtgccgcattactggccgtaagaaataattcttgtcagcgtggtcgcccggccacgcttttctccacacaactgccttaacgcctttcaggcaccgagacatcattaaattcatcaaatgaatgcctgaaataacttctttgtcactatccgtctggataaacagctgctaccagcggacaaacgtactggcgcttcaacggcccgcagccatcgccctcgtacttagtaaatgctgtccgggttgttctgcagcatccgctaacgctctttttagcgcagctggaaaaatttatgcgtgccgttcatgaacacaaaagcgcatctgtgcaccccttccgactggcaatggagaaaaatcacgcgcagcgggaagtgatcttgtcctgaaacgagacggcgatcccattcatttggggtaattagcttataaaaaaagcagattattccgcttatcttgtttctggtcgaagaaatagagagaagttacgggaatttgtaagcgcgtacaaaaccgccgacaataaataaccctatgattttactgaattataaatttattttgctgtttttaagcacgattcattgatctacaacagtggattgttcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattactgacagacctttccggacgctgtgctatgagatgggagcaggattgacagtatccgagatgatgtcttctaacccgcaagtgtgggaaagcgataaatctcgtttacggatggtgcacgttgatgagccaggaattcgcacggtgcaaattgccggtagcgaccctgttgagatggccgatgccgcacgtattaacgtggaaagcggcgcccagattattgatatcaatatggggtgcccggcgaagaaagtgaatcgtaagctggcaggttcagccctcttgcagtacccggatttagtgaagtctatactcatcggggtcgtaaacgcggtggacgttcctgtgactctcaagattcgcaccggctgggcgccggaacaccgtaactgcgtagagattgcccaactggctgaagattgtggtattcaggccctgaccatccatggccgcacccgcgcctgtttgttcaacggagaagctgaatacgacagtattcgggcagttaagcagaaagtttccattccgattatcgcgaatggcgacattactaacccgcataaagccagagctgttctcgactatacaggggcggatgccctgatgataggccgcgcagctcagggaagaccctggatctttcgggaaatccagcattatctggacactggggagctgcttccgccgctgccgctggcagaggtaaagcgcttgctttgcacgcatgttcgggaactgcatgacttttacggtcaggcaaaagggtaccgaatcgcgcgtaaacacgtctcctggtatctccaggaacacgctccagacgaccagtttcggcgcacattcaacgctattgaggacgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggacgttaatgacctgtatgagctggtactggctgaagtagaacagcccctgttggacatggtgatgcaatacacccgtggtaaccagacccgtgctgctctgatgatgggcatcaaccgtggtacgctgcgtaaaaaattaaaaaaatacggcatgaactaatttcgattagctaactgcttgtttaaaaaggcgctactcggcatggggaagcgccttttttatacgcattacatggaatttggtcatgaaagcggaatgtgaacctcagtactttggcgatgaatcgaagaagattattcacggtgacgcgctaacagaacttaaaaaactgccttctgaaagcattgacttaatttttgccgatccgccttacaatatcggaaaagatttcgacggtatggtggaatcctgggacgaagcgtcttttctggcctggctgtatgaatgcattgacgagtgccaccgcgtactgaagaaacacggcaccatgtacatcatgaatagcacagaaaatatgccgtatatcgatctcaaatgccgaacgctttttaccatcaaaagccgtatcgtctggtcctatgatagttccggggtgcaggcgaaaaaatactttggttctatgtatgaaccgatcctgatgatggtaaaaaacccgaaaagctatacctttaaccgtgacgcgattctggtcgagaccactacgggcgctaagcgcgcgctaatcgattatcgaaaaaacccgccccaaccatacaatcagaaaaaagtgccgggcaacgtctggtcatttcctcgcgtacgttatctgatggatgaatatgaaaaccatcctacgcaaaagcccagcgcgctgttaaaacggatcatactggcctcttctaacccgagcgataccgtattggaccctttcgcgggcagtttcaccacaggcgctgtcgcagcggcgtcaggtcgtaagtttatcggtattgaactcaataatgagtacgtaaaaatggggctcagaagattgagcgtcacttcgcattattcagaaaatgaacttgcaaaagtcaaaaagagaaaaacacaaaacctgtccaaaaagcagcgaaatgtcgggataaacgcgctatcttcagagaagtaaaagcattgtaagtccgcttttcagcgtcaaaatttcatgtatattcccagcacgcatgggcatgaatacacaggatttgacgatgatacgtaagtattggtggctggttgtttttgccgtctccgtttttctttttgatgcgcttttgatgcaatggatcgaattgatggcgactgaacaggataagtgccgaaacatggattcggttaaccctcttaaattgatcaattgtaccgatctggagtagcgaatcgggcgatttaacctatgattatttatcacccggatttcttttatcccttataaaaacagggaattaaaacacgttgaggataaaagaaggggtgatactgtctcgtcctgttcttttcctgcataaccaatgagctaatgatacatgccggttagtgagtacaaccacatccttgtggcggtttcatttgctgtcgctatttttgcgtcctataccgcattaaatatggccggacgcgtagccggaagcgcccgatcaaacgccagaatatggctaatgggcggcggcttcgcgctgggcgtcggtatttgggagatgcattttgtcgggatgctggcgatggatcacgcgatgaacatgcgcttcgatccgttcctcaccggcctctccatgctgatcgcgatcggctcctccctgtttgcgctatggctggttagcgctgaaaaactgcgcctgcgccgtttactgccgggcgcgctggtgatgggactgggcatcagcgcaatgcattataccgggatggcggcgctgcaatttgcttccattatcgtttggaatagcgcgtgggttgccctctctatcattatcgcgctactggcgtcctgcggcgcgctgtggctcacgttccgcctgcgtaatgagggaacagatgtcgccctgaggcgagcaggcgccgcggtattaatggggatagctatcgccggcatgcattacgccggcatgaaggccgcacactttccccaaaactggccgatggaacatcgtggcgtcgatagcaactggctggctgttcttgtcagcgtggtcgcgctgactatcctgggtattactctgctggtttctttatttgacgcccggcttcaggcccgtaccgcactacttgcctcttcgctggcgcaggcgaaccaggaactggcgcagttggcgctgcatgatacgctcacccgtttaccaaaccgggtactccttgaggatcgtctggaacaggccatcagcaaagcgaatcgggaaagcacgtctttcgcgctactgtttatggatctggatggctttaaagccgttaatgacgcttatggtcatgatattggcgataagctactggtggcggtcacgcatcgtctgaaccaaccgctgagcgggcagtttaccctggcgcggattggcggcgacgaatttgtgctgcttgcggaagtcagcgcgcctgacgaagcggcttcccttgccagcgcgctggtacattcgatagatgcgccctttacgatagatccgtacgaactggttgtcacccttagcgtgggaatagcgctctatccgctggacggaaaaaacgaacgggaactgatgttcaacgccgatgccgcgatgtaccacacgaagcatacggggcgtaacggataccatttctttcagccatcaatgaatatgctggcgcaaacccaacttcagctaatgaatgacctgtggctggcgctggaaagacaagagctcaggctggtgtatcagcctaaatttcaggctcctgccggccccattgtaggatttgaggccctgttgcgctggtatcatccaaaacaaggcgtactgaatcctgaccagtttttaccgctggcggaaaaaacgggtcttatcgtcactatcggtagctgggtgatagacgaggcgtgtcgacagctccgcgagtggcacttacagggatacgccttatggtcagtggcggtaactggtaatggaaaatggtcaggtctacccgattaaaggcacgctgcaattttccgacgttaccgtagatgaaagcaccggctctatcacgctcagggcggtgttccctaacccgcaacacagtctgcttcccggtatgtttgttcgcgcccgcatcgatgaaggcgtccagcccaatgccatccttgtcccccagcagggcgtgacccgcacgccgcgcggcgacgcaatggtgatggtggttaacgataaaagtcaggtcgaagcccgcaatgtcgtggcgacgcaggctattggcgataaatggctcatcagcgaagggttaaaaccgggcgataaggtcatcgtcagcggcttacaaaaagcgcgaccgggcgtccaggtgaaagccactaccgatgctcctgcagcgaaaacggcgcaataaggtaaccgtacatggcaaacttttttattagacgtcctattttcgcctgggttctggccattatcctgatgatggctggcgcactggcaataatgcaacttcccgttgcgcagtatccaaccattgcgccgccagcggtttctatttctgcaacctatcctggcgcggatgcgcagacggtacaggatacggttactcaggttatcgaacaaaatatgaacggtatcgataacctgatgtatatgtcctctaccagcgactctgctggtagcgtgaccatcactctgaccttccagtccggaaccgatccggatatcgcgcaggttcaggtgcaaaataaattgcagctcgccacgcctttactgccgcaagaagtccagcagcaggggattagcgttgaaaaatccagcagcagctttttgatggtcgccgggttcgtctcggataatccgaacactacccaggacgacatctctgactatgtcgcctctaacattaaggattctatcagccgtctgaacggcgtgggcgacgttcagctatttggcgcacagtacgccatgcgtatctggctggatgcgaatctgctaaataaataccagctcacgccagttgacgtcatcaaccagttaaaagtacagaacgaccagattgcggcaggccaactgggcggtacgccagcattaccgggccagcagcttaacgcctcaatcatcgcccaaacgcgtctgaaagatccggaagagttcggcaaagttacgttgcgcgtcaataccgacggctctgtcgtccatctcaaagatgtcgcgcgtattgagcttggcggtgaaaactataacgttgtagcgcgcattaacggtaaaccggcctccggtctcggtattaaactggcgaccggcgctaacgcgctggataccgcaaccgcaatcaaagcgaaactggcggaactgcagcctttcttccctcagggaatgaaggtggtttatccttatgacactacgcccttcgtaaaaatatctatccacgaagtggtaaaaacgctatttgaagcgattattctggtgttcctggtaatgtatctgttcttacagaatatccgggcaaccctgattcctaccatcgctgttcctgtcgtgttgctaggcacttttgcggtactcgccgcctttggctattccatcaataccctgacgatgttcggcatggtactggcgatagggctgctggttgacggtgcgatagtggtcgtagaaaacgttgaacgtgtaatgatggaggataacctttctcccagagaggcgacggaaaaatccatgtcgcagatccagggagcgctggtcggtatcgcgatggtactgtctgcggtatttatcccgatggccttttttggcggctcgaccggggcaatttatcgccagttctctattactattgtttcagcaatggcgctatccgttctggttgcgttgattctgacgccagcgctatgcgctacgctgcttaaacccgtatctgctgaacatcacgagaaaaaaagcggcttctttggctggttcaataccaggtttgaccacagcgttaaccactatactaacagcgtaagcggtatcgtgcgtaatacgggtcgctatctcattatctatctacttattgtagtcggaatggcggttctgtttttacgcctcccgacctccttcctgccggaagaagatcagggggtattcctgactatgattcagctcccctctggcgctacgcaagaacgtacgcagaaagtgctggatcaagtcactcattactacctgaataatgaaaaagcgaacgtcgaaagcgtgtttaccgtaaacggctttagctttagcggtcagggacaaaactcagggatggcatttgtcagccttaaaccctgggaagagcgtaacggtgaagaaaatagcgtcgaagccgttatcgccagagcgacacgcgcctttagccagattcgcgacgggttggtgttccccttcaacatgccggcaattgtcgagttaggtaccgcgacaggtttcgacttcgaactgattgatcagggaggactcggtcatgatgcgttaacaaaagcgcgtaatcaactcctgggtatggtcgcgaagcatcctgatctattagtgcgcgtacgcccgaacgggctggaagacacgccacagttcaagctggatgtcgatcaagaaaaagcacaggcgctcggcgtttcgctgtctgatatcaacgaaaccatctccgcggcgttgggcggctattacgttaacgactttatcgatcgcggacgagtgaaaaaagtatacgttcaggctgacgctcagttccgtatgctgccggaagatatcaacaatctttatgtacgcagcgccaatggcgagatggtgcccttctctacctttagctcagcacggtggatttatggttcgccacgcctggaacgctataacgggatgccgtcaatggaactgctcggtgaagcagcgcccggacgaagtaccggtgaagccatgtcgttaatggaaaacctggcttcacagctgccaaacggtattggctatgactggacaggtatgtcgtatcaggaacggttgtcaggtaaccaggcgccggcgctgtacgcaatctcactcattgtcgttttcctctgccttgccgctctgtatgaaagctggtcaattccgttctcggtaatgctggtcgtaccgctccggcgtggttggcgctctgcttgcagcgtcattgcgcggcctgaataatgacgtttacttccaggttggcttgttaaccactattggcctttctgctaaaaacgccatcctgattgttgagttcgccaaagatctcatggaaaaagaaggacgtggattgattgaagcgacgctggaagcatcccgtatgcgtttacgtcctattctaatgacctcgctggcctttattctcggggtaatgccgttagttatcagtcgtggcgcaggtagtggggcacagaacgcagtaggcacaggggttatggggggaatgttaaccgcaaccttattagctatcttcttcgtgccagtattcttcgttgttgtaaaacgccgatttaatcgccatcatgattaaccagtaaacagaggcgtcttcggacgccttttaaacggtacgtctttatctccgctattcccccctctccgcttacctctgcattctccatagtttttacaattcacatgaattgagatgattcctcatgtcagccattttttctgtggtggtaaaataactctcgttttcacagcggttagagccagcatttacgttgctgtactttgcgaaacgctgattaatgaggtaacaccatgaaaagactaattccagttgcattgcttaccaccttattggcaggttgtgcacatgattctccctgcgtaccggtttatgacgatcaagggcggctggttcataccaatacatgtatgaaaggtacaacgcaggataactgggagacagcaggcgctatcgctggcggcgctgcggcggtagcagggttgacgatgggtatcattgcgctttctaaatgatacatgcaggcgcggcaatgccgcgctttcagtaataatataaaggtcgtaaggatactcagcgacgtaatctattcagcctatccccgaaagttaacacgataaaacgctctcttttcttactcgcccatcccgatggtatttattctattccttgtccgatgcagacaaaattgtagcttgatagcatcgtaagccgcattacaaacaggctttatacagtaagacttagagcgtggtcattaggcgtaattattacagacagtctggatataaaccggaacatacacgtaatacatgaggattttgagcactgtcccagggccaaactggcaaataaaatagcctaatgggccagattcttagtcctcagcgaatatctctattgcttattagaggcgtaagtaaaagccgtttgtacatctacttcagcacggttcacattcgatggttcaggcggatatatggcgggaaatcacgtttactaaaacggtttttatccactctacgaagatgttatatacccaaaataattcgagttgcttaaaggcggcaagggagtgagtccccaggagcatagataacgatgtgactggggtgagcgacaaatctgccgggagcagatttaaacgtcgcgtgcgacggcccgtcagggcgaggcccatgaatgggccgagtaatccgtagccaacacataagcgacttgaagtatgaaaggtataaaccaaatataaaacgcgtcggcgtcattatccgataactttttccatagagagataaatgcaaaaaggcccaatctttcgattgggccttttgctttatttgatgtctggcagttccctactctcgcatggggagaccccacactaccatcggcgctacggcgtttcacttctgagttcggcatggggtcaggtgggaccaccgcgctactgccgccagacaaattctttttcaaatgccgaactttaaccgtattaagtggtgctgatacccagagtcgaactggggacctcacccttaccaagggtgcgctctaccaactgagccatatcagcacactaaatttgatgcctggcagtttatgaatcacttcgtgattcacccttcgggccgttgcttcgcaacgttcaaaagattcgcttttgtcctactctctgtcgagtagtgaactgccccgaaagttaatgccatacttctaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaaacttcgcagtgaaccctttcaggtacactctgaagtattttttcgtaaaacgtactcacgagatggtggagctatgcgggatcgaaccgcagacctcctgcgtgcaaagcaggcgctctcccagctgagctatagccccatcgtgtagtcagaacctctttaccgataatttttcctgagacaaggcgtggaataacgaagcatacatcagtatgtgagttatttcacaacgcagtattcagggaaaatctggtaggcctgagtggacttgaaccaccgacctcacccttatcaggggtgcgctctaaccacctgagctacaagcctgtagaggttttactgctcgtttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtatattacgctttcccgcttcagagtcaagcgtttattttcgcttttctccgtgggattctggtctgaaccccgctgacccggcggcctgtgtgccgttgttccgtgtcagtggtggcgcattatagggagttatttctgcctgacaagaggaaatttaaaataattttctgagtgcgcactttttattctttgcgtttattttgccgacgatttgttggttaaatgggctatttcacgggcaaagtgcgcaacttgctcccagtcggtgtacaccacttctttactggtatccgtttcgccgcccgacatcttcataataagcttgatcatcagacggtcataccagcgatagcggggatagcgaagcgcgcctgcaatgacggcacagtagtcaggtcgccacggagaactcattaaaaacttacgcgcgtagctgttagtctgcggcgtccgtttttcagctttacgcgccaccaggttaacggaataaaaggcgctcggcattccgttcaaccgcgtggcatatttcttaacaaactcctgaaaggcgctgtggtaatgaccataacgaatagacgcgccaatcactacgcgatcatagctatcccagtcagactcttctgcgcgatgcagattaacgacatcggcccagatccccatctctttgagttcagaagccagataagaggcaatttcgcgcgtttgtccgtcccgggtagagaaaagaatcaatgttttcacgtgttactccattattcacgccagaaagtcggggtaaaaagtaccagcaaagtgaatacttccagacgaccaaatagcatgttggcgatgagtatccatttcgcaaccggattcatactggcgaagttatcagcaaccacccccagccccggtcccaggttattaagcgtagccactaccgaggcgaaagccgagaaatcatctacgcctgtagcgataatggccagcatactgacgataaataccagcgcgtaggcagaaaagaatccccagacggcttccagaatacgctctggcagcgcccggttccccagcttaatactgtaaacggcattcggatgcaccagacgtttgagttcgcggttcccctgtttaaataacaacagaatacggatgacctttaaccccccgcccgttgacccggcgcaaccgccaataaacgcggaacatagcagcaagacgggcaaaaacagcggccagcgcgcaatgctgtccgtggtaaaccctgccgttgtcgccatcgacacaacctggaagaacgcctgatttagcgttgtcagcgccgagtcgtagatattatggaaccacagtaccagcgtgcagatcaccaccagcgtcaactgtacgccgatgaacatgcggaattccggatcgcgccagtataccttcaggctacgcccgcttaataaagagaaatgcaggccatagttacaaccggagatcagcaggaaaatagcgatgatggtattaatagtgggactatcaaaatagcctacgctggcgtcatgcgttgagaagccgccgatagcgatagtggagaagctgtgtccgatagcgtcaaacgcgggcatccctgcaaaccatagcgccagcgcgcaggctaccgttagcaagacatagataagccacagcgttttcgccgtctcggcaatacgcgggcgcattttgttatctttgagcggccccggcatttctgcccgatagagctgcatccccccgacgccgaggacagggagaatcgccaccgccagcacaatgatccccataccgccaaaccattgcagcatctgacgataaaagagaatggcgtgcggtaatgaatccagccccaccagcgtagtggcgcccgtggtggttaacccggagaacgattcaaaaaaagcatcggtaatggtgaggtttgggctttccgagaaaataaacggcagcgcacccacgctgcccagcacggtccagaacagcaccacgataagaaatccttcgcgggatttcagctcgcccttttccctacgatttggccaccacagtatggaaccgatcgccagcgcgacaaaaaaggtctgcgtgaacgctcctcctgcgccatcacgatatattagcgctaccagtcccgggagaatcattgtccccgaaaataagataaccagtagtccaacgattcgggtaatggcgcgaaaatgcatctctgccgcttcctttattcttaaaaatgaggtggggattattcttcaatcgctaacaattgcaatgaaccacggctaaaatccgccagttttgtggaaaatgcattcacatgagcaaaaggaagcgccaccctgagccgaacagacgcctgataatcgctggaaacgatcttcccggcaaactgtcctaataatgcttcgattccggccaactgaccgtactcacactgcaaagtatattcggttaatggcgtcttgcgttgtgtggcaagctgacgtaatgcctgattcacaccgccgccataggcttttaccagcccgcccgtacccagcagaataccaccatagtagcgcacgacgacggcagtaatttctccgacgccgctgcccatcaattgcgcaagcatcggcttgcctgccgttcccgccggctcgccgtcgtctgaaaagcccagttgttgtgagtcgtccggcgcacccgccacccacgccgcacaatggtggcgcgcatcagggtgctcagctctgactaactcaacaaacgctttcgccgcctctacgccatcggtatgcgccaatagcgtaataaagcggctttttttgatctcttcaacaacggtgaccggcgctgcagggattaaccaactgtccattacgccagttttaaatcccgcgtcatgttttccacgccgttttcgtggatgaccacgttatcttcaatgcgaataccgccgaaaggcttgagcgcttcaattttctgccagttgaagtgcttgctgaatggcccttcgcgccacggcgctaacagcgattcgatgaagtaaatccccggttcgatggtcaacaccattcgcggctgtaacacacgcgtgcagcgcagatacgggtatttggacggcgcggcgagatgcgtaccggaatcatcctgcataaacccggccacatcgtgtacctgcagacccaacggatgaccaataccgtgcggcataaacggcccggtgagatcattttccaccatcgcctcttcactcatgtcggtaatgatttgatgcttacgcagcagctttgcgatgcgctgatggaactgaatatgataatccacatagctaacgcccgccttcatggtagcgatcagcgccaactgttcgtcgttaacatctttcaccaggtgggcgtagtcgttatcgcttttcgccgaccaggtccgcgtcagatccgccgcgtagccgttgtattccgcgcccgcatccagcaggaaactgcgcatttcagacggtgcctgatgatccagtttcgtgtaatgcagcacggcggcatgttcgttcagcgccacaatgttgctgtacggaacatcggtatcgcgatgtcccgtggcggtcaggtacgccaggttgatgtcaaactcgctcatgccggaacggaaggcctcttccgccgcccgatgaccgctcaccgccattttctgcgcttcgcgcatacaggccagttcataatccgttttataggcgcggtagtaatgcagatagtcgataacacctttcgggttgatgttgctggcggcgatatccaattgtagcgcgcgctcaggaaccgggccgatatagccgatattgccacgcgcggcaggaagttggctgccgatgccatccgctttcggtaaggcgacgacctcgacttcttctgtccagaatgacgttggcagcggttcaacgttatgccagtaatcgaccggcagataaaaccacaatttgggtttgttgacgccatcgaccagcagccagcaatttggaacctgagttaccggcacccacgctttaaactgcggattgaccttaaacggataagggtgatcgtcgagaaagacgttgaaaagctcgccggaatgaataagtaacgcatccagcttaaagcgcgccagaacatcgcgcgtccgttcttgtaaggtaacaatatgatttttatagagcgcggccagtgattccattttttacccttctgtttttttgacctcaagtttccgcatcttagcacatcgccccacgagagcgtgatctctgccgagcgtgatcacatcggcatttctttaatcatttatttgcattttattaacacaaaatacacacttcgcttcatctgatacgaccagatcaccttgtggattcaggagactgacatgctttataaaggcgacaccctgtacctcgactgactggaagatggcatcgccgaactggtgttcgatgctccaggctcggtcaataaactcgacaccgcaaccgtcgccagcctcggccaggcgcttgaggtgctggaaaagcaacacgatttaaaagggctgctgctgcgctctaataaagcggcctttattgtcggcgcggacatcaccgaatttctttcactgttcctcgtccccgaagagcagttaagccaatggctgcatttcgctaatagcgtctttaaccgtctggaagatttacccgtaccgacccttgccgccgtaaacggctatgcgctgggcggcgggtgtgaatgcgtgctggcgaccgattaccgtctggcgacgccagacctccgtatcggtctgccggaaactaaactgggcatcatgccgggtttcggcggctccgttcgtctgccgcgtatgctgggcgcggacagcgcgctggagattatcgcgacaggtaaagatgtcggtgctgagcacgcgctgaaaatcggccttgtggacggcgtggtcaaacaagagaagctaattgaaggcgcgatagcggtgttacgccaggccattaccggcgatctcgactggagagctaaacgccagccgaaactggaaccgttgaaactcagcaaaattgaagcggcgatgagctttaccatcgctaaaggcatggtcgcacaaacggcgggtaaacattatccggcgccgatgaccgcagtgaaaaccattgaagccgccgcgcgttttggtcgtgaagaagcgctgaatctggaaaataaaagctttgttccgctggcgcataccaatgaggctcgtgcgctggtcggtatcttcctcaacgatcaatatgtaaaaggtaaagccaaaaagctgaccaaagatattgagacgccgaaacaggcagccgtactgggcgcgggcattatgggcggcggtatcgcttaccagtcggcctggaaaggcgtaccggtcatcatgaaagatatcaacgataaatcgttgaacctcggcatgaccgaagcggccaagctgctgaacaaacagctggagcgcggcaagatcgacggtctgaagctggcgggcgtcatttcgaccatccacccgactctcgattatgccggtttcgatcgcgtagatgttgttgtcgaagcggtagtcgaaaatccgaaagtcaaaaaagcggtactggcggaaaccgagcagaaagtgcgcccagaaaccgtgctggcctcaaatacctccaccatcccaattggcgaactggcaagcgccctggaacgtccggaaaacttttgcggaatgcacttcttcaacccggtacaccggatgccgctggttgaaatcattcgcggcgagaagagttcagacgaaaccattgccaaagtcgtcgcctgggccagcaaaatgggcaagacaccgattgtagtcaacaactgccccggcttctttgttaaccgcgtgctgttcccctatttcgccggtttcagtcaactgctgcgcgacggcgcggatttccgcaaagtcgataaagtgatggaaaaacagttcggctggccgatgggcccggcctatctgctcgacgtggtgggtattgataccgcccaccacgcgcaggcggtaatggcggcaggcttcccacaacggatgcagaaagagtatcgcgacgcgatcgacgcattgtttgacgccagccgttttgggcaaaaaaacggtctgggcttctggcgctataaagaagacagcaagggtaagccgaagaaagaagaagatgctgcggtggatgacctgctggcaagcgtcagtcagacgaaacgcgacttcagcgacgacgagataatcgcccgtatgatgatcccgatgattaacgaagtggttcgctgtctggaagaaggcattatcgcaagcccggcggaagccgatatggcgctggtctacggcctgggcttccctccgttccacggcggcgcattccgctggctggatacacagggcagcgcgaaatatcttgatatggcgcagcagtatcaacacctcggcccgctgtatgaagtgccggaagggctgcgtgataaaacgcgccataacgaaccgtattatcccccggttgaaccagcccgtccggttggttctctgaaaacggcttaaggagtcacaatggaacaggttgtcattgtcgatgccattcgcaccccgatgggccgttcgaagggcggcgcgtttcgcaacgtgcgggcagaagatctctccgcccacttaatgcgtagcctgctggcgcgtaatccgtcgcttacagcggcgaccctcgatgatatttactggggctgcgtacaacaaacgctggagcaaggcttcaacattgcccgtaacgccgcgctgctggcagaaattccccattcggtaccggcggtcaccgtcaaccgtctgtgtggttcctcgatgcaggcgttacacgatgcagcgcgaatgatcatgaccggcgatgcgcaggtttgtctggttggcggcgtggagcatatggggcacgtgccgatgagccacggcgtggattttcacccgggtctgagccgcaacgtcgccaaagcagcagggatgatggggctaacggcggaaatgctctcccgcctgcacggcattagccgggaaatgcaggaccagttcgccgcgcgttctcacgctcgcgcctgggccgccacccagtctggcgcattcaaaacggagattatcccgactggcggtcatgatgcagacggcgtgttgaagcagtttaactacgatgaagtgatccgcccggaaaccacggtcgaagcgctatcaacgctgcgtccggcatttgatccagttagtggcacggtcacggcgggcacctcatccgcgctttccgatggcgcagccgccatgctggtaatgagcgaaagtcgtgcccgtgagctgggtctgaaacctcgcgcccgtattcgctcaatggcagtggtgggttgtgatccgtcaattatgggttacgggccggttccggcgtcaaaactggcgttgaaaaaagcgggactgtcggccagcgatatcgatgtgtttgagatgaacgaagcgtttgccgcacagatcctgccatgcattaaggatctgggattgatggagcagatagacgagaagatcaacctcaacggcggcgcgatcgcgcttggccatccgctcggctgctccggagcacgtatcagcaccacgcttatcaacctgatggagcgcaaagacgcgcagtttggtctggcgacgatgtgtattggtctgggtcagggcatcgccacggtgtttgagcgggtttaattaaagataatgtcccctaaataattcacgttgcagcgcggcggcaactgagcgaatccccgggaacatagataactatatgcccggggtgaacaaaggcagccaacaaagaggcagcgtgagttatgacggggaacagtttagttgccgtttttcccgcccgtcaggggcgggttttttcaccgtgtggcctgctctactcagtaagcgctttggtcaggctaaatggcatagcctgatatccacgcgcaccatgtatttgcatttcgaccgcaggctctttttctccccatctgaactcttccagatacgggttaggcaagctggtaaatgcgcctaccgacaaatcaaactcaccacctgctgttgcggaatacacgaacacagaattcttgtcagtctggtactcggtgatagaggttaccgggctaaaccactcgttcccgcgctctttaccgtattgccagatctgttggactgtcttgtttttctggtcgattttgtaaatcacggagcggctgtatttcatactctgcatagcaggctgttctaagccgcggccatcaccattgtcgaaagcggaaaggtataagatatcgcctttactcttactatcaattttaaaggccgtatgttgcgtccatgtccaatcgaagtcaccctcacagccactttcctggcaggaaattttttggcctttgctatccacaggcgtcagaattgcggcattaaatggcgctttccagccagcaggcgtaccaagtatccacttcactttcttatcgcgaccgattttgataatcgcactctggtggcggaagctgatgatgatggaatcatcttcactgtcatagtcgacgctgttgacatgcgcccagttgcggccagccccactacccacgatatccccgaatttgtcggaggagtccagcgccgccagatcttcttcgctcaacgtatggccggactggctggcgtcgatattcaggcacactgcgccctgatcgagggttttcattatcacatcacgataaggatcgaggatatcaaacagacgccattcatccactaccacgccgttctgatcaacttcggcaatcacatcacgcacggtacgaacatttttcccatcaggacgtttatagttagagctggctacacgcaggaagtagtgaccgttgggcgcgttatccattgagtgtgaaaaatcgttataattatccggcaggcggcggttgaagatttcacgccccatgatatcgtatttcacataacgctgaccgtagccccacgatagtgcgccatcctggttttgtttaaagcccatcataacgccagcacgataaattgactttaaatcataaattgaacttggattcataaaccaacgaatatcaccggaggtgtcgataatagcgttagctgtagtgaagttccattctaatgcacccccagtagggttgttccagacagtacgcgttccattcccagacttatctttcgtattattcaaaagatacaagcgatctttaaattctggggaaacctttttaacatcgatagtaaagagtgctgattgttcttcttttgtacccgctgattcactataagcaggcggtgcatacattttatagctttcttttatattttcggttttactaccctggattcttgtatattcaacttcaacggtattgacataatccgggtaaagaccaaagacgggaataccgccatacgttaaaaggtatttattattaactttatacgcgatctcctggccattttctttgggtacaatccgcacatgcacgtcacgtaactggtaaccgccattacgaataacggcggttagcggcgcgatatcataggggttcataacaacttcgccaatttttccctggacctgatagtccactttagcgccgctggcgccgccgatggcgaaagcagtagaaggtactgatgacaaaattgcaacagataatgcgagagaagttaaagcatatttaaatttcataacactctccatcttataaataaataactaactttccattttatgtttcttttataaaaataaatgaagcatatataattaactatttttattgatagcctcaggacataatattacttaatttattacacgcaatacaaagcctgtagatattcaatatcataaggttttatagttgacgattaattaatatttaagaggacttttaggtaggctaacgtaaaaagggacgctactgcgtcccataaaatagttaaataaatgcgaacgcatcgccaaacagacgatcttcccgcgcattacgctcatgacagaacagatcgcgggcgattttcgccatctcaaaacgtccggcaatataaatatcgtgccccgccagcgtaccataatcctgcaataccgccgtaagtaccgttcctgtacgtccacgccagccttcttccggctgctcgacaacaggttcaatacgcaaattaggatggttaacagagagtgcttccagctcagagagatcatagaggtgcttttcttcgcgaccgccccagtaaatggtaacatcgcgggccgggttgcgcgctaacgccgtcaacaggatggagcgtgcataagaaaagcccgtaccgcccgcgatcagaatcaacggacgctcttcatcgtcacgtagccaggcgtcgccatgcggaatatcgacgacgatttcccggtctttcagaattcgatccatgaccgccatcgcatacagattgagctcggaagcgccaatgtgtaattcaataaaccctttctcgtccggcgttgaggccatcgaaaacgggcgtttgtcacgctcgtccattacgaccatcaaatactgaccagcgcggaatgaaaacgccgcgtccggcactaaacgaacccgatatacggtatcggtgatagcttctaccgaggtcactttacagcttaaggttgtcatgcgctccctctgtcgggtgtcgggtcaataccgacatttttcaagccgagtcgccgcagcctgaaatgtcgatgtccgctttcagttatttaaagatagccagctcatcccaaatcgcatcaatacgcgcggtaacttcaggatctttaacaataggacgaccccactcgcgttgggtttcgcccggccatttgtttgtggcatccagccccatttttgaacccagcccggagaccggcgaggcaaaatccaggtagtcaatcggcgtattttcaaccagcaccgtatcccgcgcagggtccatacgggtggtaatcgcccagatcacatcattccagtcgcgtgcgttaacgtcatcatcgcaaacgataacaaatttcgtatacataaactggcgcaaaaacgaccagacactcatcatgacgcgtttcgcatgaccagcgtactgctttttcatcgtcactaccgccaggcggtaagaacacccttccggcggcagataaaagtcgacgatttccggaaactgtttttgcagaataggcacgaagacttcattgagcgccacccctaataccgcaggctcatcgggcggacgcccggtataggtggagtgatagatggcatcctcacgctgcgtaatatgcgtgacggtaaagaccggaaagttatccacttcattataatagcccgtatgatcgccatacggtccttccggcgccatctctcccggctcaatgtaaccttcaaggataatctcggcgctggcaggcacttccagatcgttagaaaggcatttaaccacttcagttttcgtgccgcgcagcaggcccgcaaaggcatactccgacagagtatcgggaacaggagtcacggcgccaagtatcgtcgccggatcggcgcccaatgcgacggagaccgggaaacgttcacccggacgcgcggctaaccactcctgaaaatccaacgcgccgccgcggtgagacagccagcgcataatcagcttatttttacctatcaactgctgacgataaatgcccaggttttgccgttctttgtgcgggccacgcgttaccgtcagtccccaggtaatcagcggcgcggcgtcgtccggccaacaggtcatgacaggaagacgcgttaaatcgacatcatcgccagacgcgattttctgctggcaaggcgcgccgcgtaaccgtttcgtcggcatattcagcacttgcttaaactgcggcagcttgtcaaacagatcgcgaaagcctttcggcggctcaggttctttcagaaacgctaataatttacccacttcccgtaaggcggaaacatcatcctgccccatgcccatcgccacgcgttttggcgtgccaaaaaggttgcacagcaccggcatggcgtaacctttaggattttcaaacagcaacgccggtccaccggcacgcagcgtgcggtcagcgatttccgtgatttccagatgaggatccacaggtagcgtgatgcgttttagttccccctgctgctcaagtagcgtcaggaagtcgcgtaaatcgtgatatttcatggcgtccattgtagcctcttggtaagcgcatcattatacggcgttcatcatcgggatgctgtatttttgttaaattagcgtgaactctggcaaccaacgctaatccagatacggcttaaaggatgaagtgtataattaacttcgcgcatggcttttgctatgcttgcgccccgaacaagcggataagagtcattatgcaatcctggtatttactgtactgcaaacgcgggcaacttcagcgtgctcaggaacacctcgaaagacaagcggtaagttgcctgacaccgatgatcaccctggaaaaaatggtacgcggaaaacgtaccttcgtcagcgaaccgctctttcctaattatctgttcgttgaatttgatccggaagtgatacataccactacaatcaacgccacgcgcggcgtcagccattttgtgcgctttggcgcgcatcctgcgatcgtgccttccagcgttattcatcagctttctatctacaagcccgaaggcgttgtcgatcctgaaaccccctatcccggcgatagcgtcatcatcacggaaggcgcatttgaagggctgaaagcgatttttaccgaaccggatggcgaaacgcgttcgatgttactgcttaatttactcaataaagaagtgaagcagagcgtaaaaaacaccggttttcgcaagatttagcgatcgttcagaatacgacctcaaataaggttctggcattggcatctgtcatcgccgctaaccattgcggatcttcaccacgccatagcgctatgcgctccaggatgtgaggcagatatgcgggctcgttgcgtcgtgacgttggtttcggcgtaagatcgcggggcaacagatacggcgcgtcggtttctatcagtagcttttccgctggaataaacggtaagagttcacgtagctcaagcccgcgtcgttcgtcgcaaacccacccggtaataccgatatagagccctctgtccacacaggcctgcatttgctggcgtgaaccggtaaagcagtgcagtattgcaccaggaagactatccagccagggatcaagcaatgccagaaatcgctcatgcgcgtcccggcagtgcataaagattggcatctgcaattcggcggcaatttgtagctgcgcctgaaaggcacgctcctgctcctgcggcgtggaaaaattgcgattgaaatccagcccgcactcaccgatagcgacgacttccggctggttcgccagcgcaataatggcgtcttcagacgcagatgaccactgactgctgtcatggggatggacgccagccgtcgaccaacaatgggggtagcgccgcgccagttttaacgcctgctgactttcatggatgttcgttccggtcagtagcataccttttactcctgccgcaaacgcacgggcgaccacatcatcacgatcttttgcaaactggctactggttaaattaacgccaatatcaaacatgcttgcccccatatgacaaccgccctggcgggcggttgtgtttagtcttcagtgtgctcggccttttcggtctcggcctcgttatcttcgtcgcgcgtccgtcgcttaccgacataaaagcgtgagcagaaaacgccaatttcaaacaggcagtacatcggtatcgccagcaacgtttgcgagaagacatctggcggcgtaagcagcatccccacaatgaatgccccgaccaggatataaggccgttttttacgcaaatcttctggcgtggtgatgcccatccagcacagcaacacaatcgccaccggcacctcaaaggctacgccaaaggccataaaaagcgccatgacaaagctcagatagctggcgatatctgtcgaaacctgtaccccttccggcgccgtatgcgtcaggaaaccaaaggccaaagggaatacgacaaaataggcgaaggccataccaatgtaaaaaagcagcgaactggataccagcagcggtacgaccagacgacgctcgtgtttatacagcgccggggcgataaaggcccaaacctggtacaaaatgacaggcgcggataagatcaaagacaccatgaaggtgagtttgataggcgtaaaaaacggcgacgccacatccgtcgcaatcattgtcgccccttgcggcatctgttttatcagcggtgcggcgactaaatgataaatatcattggcgaaataaattaacgccagaaaaatcagaagtactgcgacgatgcagtttagcaggcgcttacgcaactcgatcagatgcgtgataagcggttgagtatcttctacagccatgtttacggtttatcactcgacgaggggaaagattcgacaacaggcgcagcggatttcttctcggcgtctatcgcggctacggaagcggtttccgtcgactcaggcacgttagctttaacgggctccggcttttgttccggcgcgctcgcctgtgtttcagcggcggcaggggtgacgccctcatgctgcgtttcgttcccttttaccaccggattatggatggtatgcgcttcatcgctcgcttgttcgggatcgttagcgctgtaggtgcgtttcatcgactccgccgcctgacgcagttcatccatagatgctttcagttcgggagtcagattttccaggctcgccttttcgacttttttcagactgtcctggaactcctgaagtttcagttcctgagtcagttcattctgaaccgttgtcgcaagggagcgcaacgcgcgaatccagcccgctaccgtttttaccgctactggcaatcgttgcggccccaacacaatgaggccgataacgaacactaacagcagttcgctaaaaccgatatcaaacacggattatacctgctctttatcttggcttttagcgtcttcctttttcgcttcgccttgcttatccgcgatagatttagcggtaaaatcagcgtcctgactggttttatcctgtttggcatcatcatcgctcatggcctttttaaagcctttgatagacgcgccaagatcggaaccgatggaaccgagttttttggtgccgaacagcagtacgacgataacggcaacaatcaacaactgccaaatactgataccacccatacatgttcctctgtgatagatgatgaattattagggccgcattatacacattatccttcgcgctgcctctttgttagccgctttcgcccgtcctattcacatacttttacatacgaccgggacgacattgacttgcggcctgagtattgcctcgagtgataatatgtacctgcgtgacacaaccggcgttgagcgataaaaaatctcaacgagttttacgccagccaaccagccagaccactacgccgccgaccatgagccagccaggcatcaatccccattcagggcggttgacgagtaagaatgacccgctcagtaacagcgttgcgccaattcccaataaataacgagactgactttggcgcacatggtttacctgtaactcgcgcgcaatcttatcaacactgtgctgtaaatatttgccctggcgcaaactgtcgtacaccagttcaggtatttctggcattttttcgacccagaacggcgctttttctttaagagcccgcgtgagagccggaatacccacctgatctttgatccaggactcaagaaacggcttcgccgttttccacaaatcaagctgaggataaagttgccgcccaaccccttcaacatacaataatgttttctgcaacaacaccagttgcggctggacttccatgttaaatcgacgcgctgtattgaaaaggtttaacaacacatgaccaaacgagatttccgcgagcggcttttcaaaaataggttcacagacggtgcggatggcaaactcaaaatcttcaacgttggtatctggcggaacccaacctgaatcgacatgcagctccgccacctttcggtaatcgcgattaaaaaacgcgataaagttttcagccagataacgcttatcttctttgtttagcgacccgacgataccgcagtcaatgccgatatattgcggattttcagggtgttcatgactgacaaaaatatttcccggatgcatgtccgcatggaaaaagctgtcgcggaaaacctgggtgaagaaaactttaactccgcgttccgccagcagtttcatgttggtgccgttcttttccagcgccgccacatccgaaaccggaatgccatatatccgctccatcaccatcatgttctggctacagtaatcggagtacacctccgggatatacagcatgggactattttcaaaattgcgacgtaactgaatcgcgttggccgattcccgcagcagattcagctcatcgatcagcgttttctcatactcacgcaccacttccgtcgggcgcagacgacgcccatccggcaacaggcgtggtacccagcgagcaaggcgataaatcagtttcaggtctgcctgaattaccggcaaaatatccgggcgaatgaccttaataaccacttctttaccgtttgatttcaatcgcgcggtatgtacctgggcgattgacgccgacgctaaaggctggatatcaaagtcgtcaaaccaggcttcgacaggtagcccccccatcgcctcttcaatctgggctttcgccagccgaccatcgaatggcgcgactttatcctggagcaaagcgagctgatcggcgatttgcggcgggaacaggtcacggcgcgtggagagcatctgaccaaatttgatccagaccggtcccagctcttgcaacgccagtcttaatcgttcacccagcaatttatctttatgccggtttggcatccagaacagcgaatagcgccataatcggagtggcagtgtaagacgcattcgggggatgagttcatcaaggccgtagcttagaaacgtgcggatgatgaaatataggcgccgtacttcacctggcgtcatttggcccccagtttttccagccgtgtggtcagagaatctacggcgcgctcaacagccgcggtttcttcggcaaaccatgcgacttccagcgggccaggcgccatacgccactcttcagtgatcgcttcagcggcataacgctgctggcgttgaaacccgtggcgcaggaatttagccccgccacgcacgaccttaccgatactttccgccgcaatatcacccgtgtatggcgccaacagctccgcaggatcgaattcggcgagatcggcgagcgccacaaaattttgcacgacctgaatatcgccctgcacttccagttcgccgctgcgaataagcgcggccaactgctgacgatcgcgtagttttggcaaaacgctagcttgagtgattaccgtacagtccgcttcgccttcccatgcccccagcacatcaacctggcgttcactgaataccaggactaatggcgtcgaaaatccctttagtttcacacacagtacttttccctgtaagcgcgttctggctgatttcagcgctggcgaacgatacagaaacgtattgaggagaccttcaattcctgcggtcactaagggtttaaaaggcattccaccctcctagaatttataaccacggtgcaatgccacaacgcccgccgtcagattgtaataatccacgctctcaaatccggcgtcctgcatcatggcttttaaggtatcctgatcgggatgcatacggatggattccgcgagataccgatagctatccgcatcgttcgcgaccatcgagccaatacgcggtaaaatatggaaagaataggcgtcatacgctttactcagcggctcaatgataggcttggaaaattcaagcaccagtaaacgtccgccgggtttcaacacacggaacattgaccgcagcgctttttctttttccgttacattgcgcaaaccaaacgaaatggtaatgcaatcaaacgtattatcagggaaaggcagagcttcggcattcgcctgcacatactctacgttgccgatcacgccgatattacgcagcttctcacgccccattttgagcatagaatcattaatatccgccaggataactttgccagtttccccgaccatacgtgaaaatttcgcggtaagatcgcccgtcccgcccgctaaatcgagaacggtttgtccacgacgcacgccactgcaatcaatggtgaagcgcttccacaaacgatgaatgccaaatgacattaaatcattcatcacatcgtactttgacgccacagaatgaaaaacgtgggccaccatgtcagctttctgctctttagcgacggtctgaaagccaaagtgcgtcgtttcttgtgaatcttccaccatctcagtgcctgcttatcgataaaaatgttcaagaagtgtaacagattgggccaatttgccctactctgcgccaggactaaactactccgtatgggttaacttaactgctgcttcacccgttcatcattgggataatgttcatcctgccgcccttcagggatcgatcgtaaacgatattcttcatcttgcgtaacggcctgttccgctaaatccggattaatctcgcgtttgatttccacgcctagcccccggaaggcctccgcctgcgccaaaacgttgccacgccccgacgcaagttttttcatcgcctggcggtagttatcctgcgctttatccagactctgaccgatcgctgacatatcatcaacgaacaaccgcattttatcgtagagcttactggctctgtctgcgatgtgctgcgcattgcggctctggtgttcatagcgccacaggttggcgattgtccgtaacgccaccagcagcgtcgtggggcttaccagcataatgttatttttcagcgcctcggttatcagttcgggctgtttatctaacgccagcaggaaagcgggttctacggggataaacatcagaacatagtccagcgagcggaggccgggaagctgctggtagtctttacgccccagtaagcgaatatgattgcgcaccgaggcgatgtgctcttgtaaagcggcctcgcgcgtatagtcatcttcagcgttaaagtaacgctcgtaggcgactaacgtcattttagcgtcgatgaccacatctttgccctgcggcaagcggacgatgacatccggctgcatccgcgagcgcgcatcgttctcaatactgacctgggtttcgtattcgtagccttcacgcagtccggatgcctccagcacccgcgccagcacaacttcgccccagtttccttgtgccttattgtcccctttcagggcgcgcgtcaggttgatcgcttcctgcgccatttgcgcgttaagctgctgcaaattacgaatttcgtgcgccagcgtatgccgctcctgcgcttctttgccaaaactctcctgaacctggcggcgaaaaccgtccagttgctcacgcagcggcgtcagcaggctattcaggctttgtcggttttgttcgtctacgcgacgattactgtgttcaaagatacggttcgccagattttcaaactgctcgcttaaacgctgttcgctgttgatcatctgacggattttgtcttccgcgtgttgttgagtcgcttccagacgagtcgtgacttcacgcagatcggcttccagagaggtattaatactgtgcaggctacgcagttcgttattaagtaactcgcattcactgcgccagtgcgcttcttgcgctaattgctgccgggccgcgctaagttcaatatccagctcacgccgttcttcgataagatcggcgcggatttgatcggcgtgcgctttcgtcgccagccagccaatcaccgccccagccgccagcgccacgacggcgcttatcataagagtaatatccacaacacctctcctggaaccacactgtcctgcacaaaatagaattgtgctgtataaacgtccagtttaaaagggatttcctgcgaggcgccacgcaaaaagaaaaggccgaacgcgtcggcctttgcaaaagagaggagaattacagcagacgacgggccgcttccacgacaattttcaccgcgtggctttcagtttgtttcatcgtttccgcattcggaatctcttgttgggtacggttaacgataacgcccgccaccatacctgcgcgtaaaccctggcttgcgcacatggttaacagcgtagcggattccatttcgtagttcatcacgcccattgcctgccactcttccatagagcctttgaagcgacgaacaacgcggccagaataggtgtcgtaacgttcctgacccagatagaaagtgtcggaagaggcggttacgccaacgtgagtcgtggcgccaatcgatttcgcggcttcaaccagcgcggtggtgcaggcaaagtcggcaaccgccgggaattccatcggcgcaaaatgcaagcttgccccatccagacgtacggatgcggtcgttaccagaacgtcgccgacgttgatgtgcggctgaatagcccccgtggtgccgatacgcaagaaggtacgaatacccagttgcgccagttcttccacggcaatagaggtagacgggccgccgataccggtagagcaaacgataactgctttaccatccagctcagcgcgccaggaggtgaattcgcggtgagatgccagcttaaccggcttatccatcagcgcggcgatcttttccacacgctcaggatcgccagggacgatggcgagctgggccccttgtaaatcgtttttggtgaggccgagatgaaaaacatcagacttggacatataaaactcctctgtgaatcgggtttgtcagaagaagcaaaaagacactttacctaaggcataaagatattttcgtgacagccatcactatggcgtaaaacaattgcactcgtttaccattaaaaagtgatgtgcatcacaataaataatcaatatcgccaagcattgcacaaaagatagccgctttaaggcaatgtggtttgttacacactgtctatagttaagattgcgctattttttaagggtacggagaataccatgacaacgacacatccatccggctttgcacctgcagcttccccacttgcccctacgatgattcatacacctgatggggccattagcgcggggataacgtcgatcccctctcagggcgacgatatgccagcctattacgccagaccaaaggcaagcgacggcgcgctgcctgtggtcattgtggtacaggaaatttttggcgtacatgaacacattcgcgatatttgccgacgactggcgctggaaggctatctcgctatcgcgccggagctctatttccgcgaaggcgaccccaatgatttcgccgatatacccacattattgagcgggctggtggctaaagtacccgattcgcaagtccttgccgacctggatcacgtcgccagttgggcttcgcgcaacggcggggatgcgcatcggctgatgatcaccggtttttgttggggaggccggattacctggctatacgccgcgcacaacccacagttaaaagcagcggtagcgtggtacggcaagctggtgggcgacacgtcactcaattcgccgaagcatcccgttgatatcgccaccgatcttaacgcgccggtactgggtttatacggcgggcaggataccagtattccacaggagagcgtggaaaccatgcgtcaggcgctacgcgccgctaatgcgaaggcggaaatcgtggtctatcccgatgcagggcacgcgtttaatgccgattatcgtccgggctaccacgaagcctcagcgaaagacggctggcaaagaatgttggaatggttcgcgcagtacggtgggaaaaaaggctaaccacagcgcattacgatgtttgttgggcctacgagaccggagtcggtgtaggctcaacaaatcgtcatcgccacgttagctatgctttaccacagcatttttatattttttgccgctgccgcagggacagagatggttacgactgacggctcctgtgtctttacgcgcgtcctgcgccagccagcgcatgatcgatgccatcggatagccttgcgccagcagctcccgccagacattcatatacggcgtaacgtgctggaaaaaatgtttatagcccgtacacaagtaattatgcgcaggatgaccggacggcgagacggcaaagcgatgcttcggacagccgccatgacacgcaaagcggtagtcacagcgacgacaatcggcggtcagggtctcccgcttggcctcgccaaacgcaatagcccgctcgctattatttaaggttttgatgctgtgctggtggatattccccagcagatgctccgggtagacaaagtggtcacagttgtagagatcgccgttcgactccaacgcgaaggcatgtccacaagtctcggaatgtacacacagtaccggctgctgcgccgtccaggcggctaacgccacgtcaaacatctgcacatagacgcggtctacgtcgcgacgaacccagatatcaaagatctggttgagaaattcgccatattgccacgacggtaccgtccatggcgccagctttgccgcgctttcgccgggcatcaccagattaagtaccgatgagttatcggtgctcattcgctctaccagcgggataaactgaataaaacgcgatcccgccgccagaagaaattcgtagacgtctgctgcatgaccgacgttatgttttcccacgacggttaaggtattaaagtcaacatggtgcgctttaagccgcgccatggctgcgacgacctgttcatgagttccttttccagcgcgattaagccgatagtggttgtgtaacgacgccggaccgtcgatagagagaccgatgagaaaatgctgttcagcgaaaaagcgcgcccactcgtcattcaccaggatgccgttcgtctgtaacgcatgagtgatttttcgcccatcgccgtacttttcacacaatgcgacaacccggcggaaaaatggcagccccatcatggtcggttcgccgcactgccaggcaaagtcaatgcggtcgccactctgcgcggcaatatgctggcgtataaactgttccagcgtctcgtccgacattcgccagtttttattgcgttccgggtacagcgcctctttttcaagatagaagcaatatgtgcaatcaatattgcagatcgcgccgccgggtttggccattacgtgacaacctgctaccgccatgtcagacatctccgttaaaaaataaggttcaccagcgccatgagacaatgcgacgtttatcgtcgccagggaacataacagaatggaaaacctcgttttgtgctatgagagcgctgggcgatcatgacaggaaaaacgatctgcgaggcaataaaatccgccgcgctgcttccggggacgctatccgcctggttgtcattcatacggagaacctttttattatcaagatcgccaaatagccagatcctgaaaaagacagcgcggaaaataagaaaaagggaaatgagaagaaagaggcgctgttaatcaggtcagacacgggcgctacccgtcaaagggtagcgccgcattgctgccggataaacgcagcggtcaggatgggttatttcgcctgacgcagattgtgcgccgctttgaccatgttcgctaacgccgcgcgggtttccggccaaccgcgagttttcagaccgcagtccggattcacccacaggcgttgtgccggaatacgttgtgccgccttcttcagcagggcttcaatccactcgacgctcggcacgttcggcgagtgaatatcgtacacgcccggcccgatttcgttcgggtagtcgaacgcttcgaacgactccagcaactccatatccgagcgggaggtctcaatggtgatcacatccgcgtccagcgcggcgatcgaatccataatgtcgttgaactcgcagtaacacatgtgggtgtggatctgggtttcatccttcgccaccgccgcgttgatgcggaaggcttccacaccccattccagataggcgtcccagtcgctgcgacgcagcggtaaaccttcacgcagcgccggttcgtcaatctgaataatcccgatccccgccgcctccagatccgcgacttcatcacgcagcgccagcgcaatctgtttcgcaatcgtttcgcgggtcacgtcttcgcgggggaatgaccagcaaagaatagtcaccgggccggtcaacatcccttttaccggcttgtcggtcagcgactgggcatatttcgcccactccacggtaatcggtgccggacggctgatatcgccaatcactaccggcggtttcacacagcgggagccatagctttgcacccaaccattctgggtaaagacgaagccgtccagatgctcgccgaagtattccaccatgtcgtttcgctcggcttcgccgtgtaccagcacatccagccctaaacgctcctgctcgatgatagcctgtttgatatgttcggcgatgccggtgcggtagttgttcgcgtcgaggttgccctttttgaagtccagacgcaggccgcgaatttccgtggtttgcggaaacgaaccgatagtcgtcgtcggccaggcgggaagtttaaagcgggcgcgttgcgcttcagcgcgcacctcatacggattctcacgctggctgtcctgcgcggtgatcgccgccaggcgtttttctactgcggcattatgtacgcgatgggagcgacgacgagcctgaatcggtacgctccattcctcaagcgccgccgtttcgccgctgttcagcgcatcgcgcagcaacgccagttcaccgcatttttgcagcgcaaaggcaaaccagctttttacttccgtatccagacgcgtttcgacgctgagatcgatcgggctgtgcagtaaagagcaggaggatgctacccacagcgcgcgtttgcccacaatggcgttaatctgcgcgtatttttcggtcaaatcggcgcgccagacattacgcccgttaatcaagcctgcggagagcagccagtcgaccggcagacgttgatgcagttccactacatcatctttgccatgaatgaggtcaacatgtagcccctgtaccggtagcacgataatagtgtccaggtttggcgtcacgccttcaaaataggtcgtcagcaacagcttcacctggccggcgagcgcgtcgtaagccggtttgaaggcatccagccacgcctgcggcagttccagcaccagtgctggctcatcaatttggacccactcaacaccacgcttcgccagctcagccagcacgtgctgatacaccggcaaaatgtctttcagcaacgtcaggcggtcaaacggctcgcctttcactttacccagccacagatacgtgacaggccccagcagtacgggtttgatcttatgccccagcgccagcgcttcgtccacttcctccagcaactgtgtccaggtaagcctgaactgctggcctttgctgaactccggtactatgtagtgatagttagtattaaaccatttggtcatttccgctgccgccgccggttcgccggttggcgcgcgaccacggccaatgcggaacagagtgtcgatgtccacggaaccgtcgttgttctgatgacgagccggcacattgcctaacagcaggctggtggtcagaacatggtcgtaccaggcaaagtcgcctaccggtaacaggtcaatacccgcttgtttctgctgctcccagtgacgcgcgcgcagttcgcggcccaccgccagtaacgcttcacgcgttgtgttccccgcccagtagctctcttgcgcttttttcaactcgcgacgcaggccaacgcgaggaaaaccgagggtatgagtcaatattgtcattttacttcctctcttattttattgaatctgaaagtaaaactctaaatagttcggcttgcaggaaggcggcgacacagcgcatccccaggagcttactgaagtaagtgactggggtaagcaaggaagccaacgcatctgcaagtcgaaatatgacgagttttagacgtctggatgtttacacatccataatgtaaaggtactgtatattcctcaagcgcaatttgttcatggcgaagtgaaggactttcatgatcgaaattaaacatctgaaaacactccaggcattgcggaatagtggatcgctggctgctgctgctgcggtgctgcaccagactcaatccgctctgtctcatcagttcagcgatctggaacaacgccttggcttccgcctgttcgtgcgtaaaagccagccgctgcgctttacgccgcagggggaagttctgctgcaactggcaaaccaggtgctgccgcaaatcagccgtgcgctgcaggcgtgcaacgaaccgcagcaaactcgtctgcgcatcgctattgaatgtcatagctgtattcagtggctgaccccggcgctggaaaacttccgtgcaagctggccgcaggtagaaatggatttcacatccggcgtcacttttgatccgcaaccggccttgcaacaaggcgagctggatttggtgatgacgtcggatattttgccgcgcagcgggctgcattattcgccgatgtttgattttgaagtccgactggtgctggcgcccgaccatccgctggccagcaaaacgcagattacgccggaagatttagccagcgaaacgctgttgatttacccggtgcagcgcagccggctggatgtctggcgacatttcctgcaaccggcgggtatcagtccgctgctgaaaagcgtggataatacgctactgctgattcagatggtggcggccagaatgggtattgccgccctgccgcactgggtggtggaaagcgttgagcgccagggtctggtggtgaccaaaaccctgggcgatggtctgtggagccgcctgtatgccgccgtgcgcgacggcgaccagcgtcaggcggtgaccgaggcgtttattcgctcgacgcgggatcacgcctgcgatcatctgccgtttgtgcggagcgcggagcgacccattttcgatgcacccacagcgaagccaggatcacagccgcgcctgtaataaagcttggccagtggggctgctgatgccagatggcaagattaaccagcagtcctgcgggaacatgcatattattcatgatacccagcgtcccggcgtctacctgggtagcgccatagttccacataaagtagccaatgccggacgccaccacgccgagaaacaccagaatgctccattgcagcgtggtttccggcagcttttgcgcgttccccaacagcgaccacgccaccgccgccaccaaaaacgcccccagatagaaccacgcaaaggcgttgtgctgcggcatgggacgggtctccatcagacgtttataccccaccattccgatagcgaaactgatattagaaagctgcaccaggagcaaaccgacccaaaaatggtcggtcacgcgatcgtagcgaataatcccggcgccaatcaccgccagcaacgcgctaaatgcatagccccagcgcaaacgacgctgactcatcacatcgtaaatcagcgtgatatagagcggcgtcaaaacggtaaacagcagcagttcggatacggtcaggtagaggtaagcatggaagctcaacatatacatgatgccaagctgcatcgcccccaccagcatatacaggctgatggtttttaggttgtgcccgcgagtacgcaaaaacggcagaaaaacgagcgccgccagcccaacgcgtatcagcaccgcgaaatagctatcgacatgcccggcaagatactcgccaaatagactaaaggagaaagcccacaggatagtggtgatgatgagtagcgccacaatggatgtctcttaaaacagggaacacccattgtagcggagagtgaggttgacaactggtcaactaacaaacaatcacatcagcgtaagaaaagatcgcgcaggtaatgcggcacggcgttatccgcgttgatgccgatcacctcaagttcgggatacaggtctttcagacgctggtgcgcattgcccatgatgcagcctttgcccgccatcgtgagcatttcagcgtcgttcattccgtcgccaaaggcgatacactctttcaggctgtaccccatcgcctgagcgaccgcttccagcgcatgacttttcgacactccgcccgccatcacttccagacaggttagcgtagagaagctcacgtttacccgatcgccccagcgcgcgttaatcgcctgctccagcggcaacaacttttcatgagtgtcgctggtgaaaaacactttgctgacgccctccggctccagcagcgcaggctcaaacagcgaatagttaaataccgcctctttgaaaaaacgcatttcatcggggcgatgacgattcataaaccattcgtcgtcgcgataaacgttagtcacgatgtccgggttcgcattcaccacgccgaacaggtcgctggcaatgtcgctgtccagattatgcgtaaaaaccaaattcccgtcggtatcgtgcactcgcgcgccgttggaggtgatcatgtaagacttgatttcaagattatcgcggatttgccctacatcgacatgatgacgaccagtggcaaagacaaaatggatgccgcgtgcggtcaacagcttcagagtctctttggcataaggggacaacgtatggtcgggggagagcagcgtgccatctaaatcagacgcaacaacctgatacataataaaatttaacctctaagcaaagcgatttccgctggataaattaggcttgttgaaaaattcaacaatggcgttaagcgcgactgagcgcatggcgtccttttcaaaaaggatctcatggtacgcgcctttgataaccagcggttttcccccttcacaagggtatcccgccgcggcgcgaatttcacaaaaacgatcgtgggtgcggttatccactacccgctcttcttccgcctgaatcagtagcgtaggcgtcgtgtcatcgctcgccccagccagtacctgctcacccgccagaatgccttcgcgtacccaatgccaggtggggccgccaacgcgcagctgcggctcgtcggcataaaatcgtaagttgcgctgataacgctggcggctgtgggtcagcgcattcatcccaaacggcaacgcccgccactgaccggtaccaatagcgtaatcttcacggatacgctgatgcccttcggcccagtcgagaatatggcgcaccataaaggaaggcaagcgtatcacaataccaaacatcggcgcggtgagcgcaatagcgtcgcaccgcacacgatggcgttgcaggaacagggtggctatcgcgccccccattgagtgcgccaggatataacgcttacgccacgaccccggctcaatttcctgctgccagaacgccgctaagtcctcaacataatcgttaaaatgatcgacatgaccccgatgcgggtccgataacatccgcccggagcgcccttgaccacggtggtcgatgatgaagatatcaaaaccgagatgaaaaaggtcatacgccagttcagcgtattttacataactctcaatgcggccaggacaaatgacgatcgtccgatcgttggagtcattccgaaaacggacaaagcgcaccggaatgttatccacgccgataaactccgcctcttcccgctgacgccaaaaatcggtcagcggccccatagcaaaagcggcaaacgcattttctcttgtttcccagtcattttgctgctgaaacatcgggttttcggcctcgtttaccaggtaaaatcgttttttgcgtcgtgcctgacacaacacagcggcagtagcgtattgtggcacaaaaacagacaaccaaggagtttcgcatgacctttgaatggtggttcgcctatctactgacctcaactctgttgagtctttctccgggttcaggcgccatcaataccatgacgacgtctatcaaccatggatatcgtggcgcagcggcttctatcgccgggctccagaccgggctggggatacatatcgtactggtgggcgtcggactgggtacgctcttttcgcgctcgctcatcgcttttgaaattctgaaatgggctggcgcggcttatcttatctggctgggtatccagcaatggcgcgccgcaggcgctatcgatctgcatactctcgcccagacgcaatcgcggggtcggctgttcaaacgggcgatatttgtcaatctaaccaatcccaaaagtattgtctttcttgccgccctgtttccgcaattcatcatgccgcagcaaccgcaactggcgcagtacctcattctcggcgtcaccacgattgtggtggatatgattgtgatgaccggttacgccacgctggcgcagcgcattgccgcctggattaaaggaccaaagcagatgaaggcgctgaataaagcgtttggttcgttgtttatgctggtaggcgcgctcctggcgtcggcaagacacgcgtgatagtcgtgccggatgatgtttatccggcccggaggtaaattaacgcgaaataatcaggtgaataccaaagcccgcaaacagagcgccggcaaagccatcaatccatttcgccagacgctgatagccacggcgcattttcggcagcgcgaacaggctggcgactacggtaaaccaggccagcgtttccagggtaattaacgcgaaaataccccagcgcgccgcagcgccgacgttatcgccgacaaacagtgaaaaaacggaaccaaaatagataatcgctttcggattcgacagattggtcagcagccctttgagaaaactgcgcccgctctgcgccagttcaatgtgcggagaagacgccgccgcatcctgttttttcagcgcgccgcgcagcatctgatagcccatccagcacaggtacaggccgccgcctaccataatgatcgtatgcagccaggccattttttcgatgatgagatgcaggccaagcagcgccacgcccgcccataccatcacgccgcaggtgatgcccagtacgcccatcatcgcttctttacgcgaacggctgacggcagtttgagacacgaagaaaaaatcggggccagggctcattagcgcaacgatgtgcaccattgccacggtgaaaaatagcatcaacataaaaatggctcgcggggaaatagttcagtgagtcaccatcctggcacttttttgccgggctgactactcttcgtcatcaccatcgacatgcgcgcggatgagcgccatgaattctttcccgaagcgctccagtttgcgcatcccaaccccgttaacgcttaacatctcgctggcggaaaccggcatctgttccgccatttctatcaacgtggcgtcgttaaagaccacatacggcgggatattctcttcatcagcgatagctttacgcagcttgcgcaacttagcgaacaatttgcgatcgtaattaccgccgaacgatttctgcatcacgcggggtttgagggcgacaatgcgcggcaccgcaagctttagcggaacgtctccacggagtaccggacgcgcggcatccgtcaactgtaatgcggagtgctgcgcaatattttgcattaccagccccagatgaatgagctggcgaatcacgctcacccagtgctcatggctcttttcgcgtcccatgccataaaccttgagtttgtcatgaccgaaatcgcggatgcgttggttattcgcgccgcggatcacctcgacaacgtagcccatgccaaaacgctggttaacccgaccaatggtagaaagcgcaatctgggcatcgtttaagccatcatattgtttggacggatcgagacagatatcgcagttgccgcacggttcttgtcggccttcgccaaagtaattaagcaataccaggcggcggcaggtttgcgcttcggcaaaagcgcccatcgcattcagcttatgccgttcaatatcctgaagctgtccggctggtttctcttccagacaacgacgtagccaggccatatcagccggatcgtaaaatagcatggcttccgcaggcagtccgtcgcgcccggcgcggcccgtttcctgatagtaggattcaatattacgcgggatatcgaaatgcacgacgaaacgtacgttaggtttgtttatgcccattccaaaagcgacggtcgccaccacgatttgcagatcgtcgcgctgaaatttttcctgcacatcggcgcgaatagcgttttccagccccgcatgataggccgccgcgctaatgccgcgactttgcaagcgcgcggcggtatcttccactttcgcccgactgttgcagtagatgatacccgatttgccgcgttgctcctgaacatagcgcattagctggtcgagcggcttaaacttctccatcagcatgtagcggatattcggtcggtcaaagctactgatctggattaacggatcgttaagcccaagcagacgaataatatcctggcgcgtggtgtcgtcggcggtggcggtcaatgccataaacggcaaagcgggaaaacgctggcgaagctgaccgagagccgcatattccggacggaaatcatgtccccattgcgagatacagtgcgcttcatccaccgccagcaataccggattccagtgcgccagatgatcaagaaagttgtccagcatcaggcgttccggcgcaatatacagcagacgaatctgtccggtacggcaccccgccatcacctcaagctgctgctcgcggctttgagtggagttcagacaggccgccgccaccccgttcgccagtagctgatcgacctggtctttcatcaacgagatcaggggcgaaacgacgacggtcaatccgtccagcaacaacgcggggatttgatagcacagagatttgccgccgccggtgggcatgacgaccagacagtcgcgaccggagagcgcagtatcaataatcgcttcctggcccgggcgaaactgttggtagccaaaggtttcctgcaaaacctgtttggcccctgattccagattcaacacttccgcctgcgccacattaaccccgttcaccataaatcaaaacaggcgctattttcagcgcctgcgagagaaactgcaatgtttaaaacacaatccaatcagaagatatcgttaagcatcacgccgacgccgacacgtgtctgattaaaattatagtcgatcagcgattcgccatagccgctatacacctgggtataaagccggacatgtttagtgaccggatagcttaatccaacttccgcgccgccgtagcctgtattccagttgtactggcctttggcgcttaataccgcctcgcccaggtgataaccgattttaagctggtaataacccatatatttggtgatgtccggattatcgtcggtactgccaatcacgtaccatggtttgacctctaccagccagttaccgttttcggccatcagacgggtatacagacggttccagctacgcgaggtggggtccgaacgtccgttagagtcatggttgtagcccatctctacgtcgcgcagcgtccagccggcaaagcgataatcggtagcaaaaccaagaaaaagctgcggttcgtagttggtttcgcgaaacggcgaagactctttactgttggaaagctgccaccaggatttctgcgtataggaagcgcccagtaccgagttcggccccagtattccgcgccacagcggaaacgccaggctcaactgaaatttcacttcatctttacgtgcgttttcagaccagttgtaggtacttatggcctctttgttcagatcgctggtgttcgtgtagatcaagtagttcgtgtcataagggtaaagcgtaaaagggttatcatgctcctgtagcatgttagcgatgatacttccccgtactgcaggcgcatcatgaacctcttttatcgtagcttcttgtgcatatgccgctaatggcagtagcgtggctggcaacaaccctctcaaaatcgcccgcattcttgacgttctcctgacgaagtattttcagcttgaatcattctctgccaaccatttttacatatttacacacatagccgttagttatcccttcttaaagtagaaaacaacaattaagaagcataatatcaacatttcattaaccaatggagtatcaggaatctatgtccgctgtacttaccgctgaacaagctctgaaattagtgggtgaaatgtttgtctaccacatgccgtttaatcgggcgttagggctggagctggaacgctatgaaaaagcgttcgcccaactggccttcaacaaccagccgatgatggtcggcaactgggcgcaaagcattttacacggcggcgtgatcgcctctgcgctggatgtcgccgccggactggtatgcgtcggcagcacgctaactcgccacgaaaccatcagcgaagatgaactacgccagcgcctgtcgcggatgggaacgattgacctgcgcgtcgattacctgcgtccgggcagaggcaaccgctttacggccaccagtagcctgctgcgcgcagggaataaagtggccgtcgcccgcgtggaattacacaatgaagatcagctgtacatcgccagcgccaccgctacttatatggtgggataaaagcaggtaaactgttgttacacttcagatacgagttttccggatggacgcaaaacaaacacggcagggcgtattactcgctcttgccgcctattttatttgggggatcgcccccgcatatttcaagctgatctattacgttcccgcagatgagatcctgacgcaccgcgtgatttggtcatttttctttatggtggcgctgcttagcgtcagccggcagtggcgacaggttaagcgtttactgaaaacgccaaagaagattttcctgctggccctgtccgccgtactggtcggcggtaactggctattgttcatttgggcggtaaataatcaccatatgctggaggccagcctgggttatttcattaatccgctggttaacatcttgctggggatgatttttcttggcgaacgcttccgtcgaatgcagtggctggcggtgattctggcggtgtgcggcgtgctggtgcaactctggacctttggctcgctgccgattatcgcgctggggctggcgtttagttttgcgttttacggcctggtgcgtaagaagatcgccgttgaagcgcagacgggtatgctggtcgaaacgctatggctgttgccggtcgccgcgatttatctgtttagcatcgccgatagcgccaccagccatatggggcaaaacgcactatcgttgaacttgctgttaatggcggcgggtgtggtcactacgattccgctgctgtgctttaccggagcggctacgcgtctgcgtctttctacactgggctttttccagtatatcggcccaacgctgatgtttttactggcggtgacgttttatggcgaagtgccgggcgcggataagatggtgacatttgcgtttatctgggtcgcgctggcgattttcgtgatggatgcgatttatacgcagcgtaaaaaataacgcgactattattctaaatataatctgaaaaaatatgcctccccttgtaaggggggtagcatattgtcatgctaacgacgtaacccaacatatggatgtgaaattaatgttaagtgtttttattccttcatctgagagatgtgtttccagatgtcgttatttattatcattcgcgctaataaatataatattttccattttggttggggttttattatatttaagctttgtgatactggcaattttattcacaattttactacattatctcgtcattaatttaaactgtcagcgattcagagacagtgactttgaatatataaaattctatgtatggggtacgcttgtaatctatattgcctccttcgtgataatggttgctgaagatttcgcttgcgatggctttggtatgcctctttttctaatctggtattttgcaaccttttctctgctacttctggcccccccggattcgaattcactcaacaagtaatttaatggagtttacatggacaaggattatattaatgatggttcgttatctgaaaaatggaaataccgtttttcattttacgatcaacatggtttccctggattttggaaagtaagcccagaatataaacaggcatttaaagcattaaagccccgacaacggttgactattcaaataaactttattgcctttttcttctcatggatttatttgtttgtactgggtctgtggaaaaaagcaattatagttattttattagggatcgttgcaatatttattggagcattaatcggcgttaacatacttggacttgttgtcgcagcttatgtcggcgtcaatacaaataagtggttctatgaaaaagaggttaaaggtatcaatacttggagcctgtaacttttcagggtggttcagccgcagctgaatcaccctggccttaatgtcttacagccagttcttgcgcttaaagtacagatacggcgcaagccccgccagaatcataaagataatcgcgcctggataaccaaagctccacttcagttccggcataaactcgaagttcatcccatagctggaagcgaccagcgtcggcggcaggaacaccacggaaaccaccgagaagattttgataatgcggttctgttcaatgttgatgaaacccatcgccgcctgcatcaggaagttcaccttctggaacagcgattcattgtgcggtagcagagattcgatatcgcgcaggatctcacgcgcctgctccagctgtccgcccggtaagcgcgccttgcgcaccaggaagttcagcgcgcgctgggtatccatcagacacaggcgtaccttccagccgatatcttccagttccgccagcgtggagagcgcttcgtcgtattcatcgccctgatgcccttccataatgacgcggctcagtttttccagatcgctgtagatgttttcgatttcatccgccaactgttcaattttggtttcgaacagatcgagtagtagttcgtaagcattaccatcgaccatcgcctggctgcgggcgcgcatacgatacaaacggaaggcgggcagttcgcgttcacgcagcgtaaacagacggccatcgcgaatagtgaatgccaccgtagagttaccggcatgatcttccgcatcttcgaagaagaagaaggagtggatatgcagtccgtcttcgtcttcaaagaagcgcgcggatgcttcgatatcttccagttcaggacgcgtcgccagactctggcccagctcagattgtacgcgcaatcgctcgtcgtcgtccggttcgaccaaatcgacccatacggcatcaatcaggctttgtgactcctcgacttccagccgggtcagtcggtttttttccagttgaaatgcgctcagcatgaccgggactcccaatgcgtaaaaatatcggacagttcagatgggcacacagaaacaaattgggtttcagaccattaaacagcctgactcaacgcgacgggaaaaaatgaaaggtcgctgacaaccgctaaggctatcagcaaaaagggatagccttaggagttgatcctggatgacaggataatgagccagtatctactgggtgtgtccaaggcgaatgtcctcttagcgtaatcgtgggcgcatgttacgccagcaaaaatttgccgtcaacacgcaacgaaacgcgaaaaagcaataatttccccttatgcagaaaggttagcagagtgagagtatttatctatgatttcagaatattaacatcaatatatcgccggatggcagcttcgccttatccggcctacaaatcaaaatgttagccagcgcgtaggccggataagaggtgccatccggcaatatgagagccggtcaaaccgtttccagcttcgcatacgcggcaaccagccatttgatcccttgcccctgaaaagccacctgcaaccggctatgttcgccgctgccctccaggttgacaatagttccctcgccgaacttcgcatggcgcacgcgttggccgagtttgtagcctgtgtcgttttccgccagcggcgttcccattcgttgatggctcaccggacgactgacggtggcgcgcagacggacctcttccacgcactcctccggcaactcgccgatgaaacgcgacgggcgatgataaacctctttaccatacagacggcgagtttcggcataggttagcgtcagtttctgcatggcacgggtaacgccgacgtaggccagacgacgctcctcttccaaacgccagccctcatccagcgacatctggctggggaacatcccctcttccatcccgacgataaacacctgcgggaactccagccctttggccgagtgcagcgtcatcagctgtaccgcatcctgccaggtatccgcctgcccctcgcccgcttccagcgccgcgtgagagaggaaggcctgcaatggcattaaatcttcatcttcgtcgttgtagctgaactgccgcgttgccgtcaccagttcctctaagttttcgatgcgcgtctggcctttctcgcctttttcttgctcatacatggtgcgcaggccggaatctttgatcacccggtcagtctgcacatgcagcggcatgtcggcggtttcctgcgccagggcgtcgatcagttccataaagcgttgcagcgcgctggccgcacgcccggccagggctttttcctgtaacaattcacggcacgcctgccacaatgttagctggcgatcgcgcgaggtctggcgcaccacgtccagcgtgcggtcgccgataccgcgcgttggggtattcaccacgcgttcaaaggcggcatcatcgttgcgattggcaatcaaacgcagataagagagcgcatctttgatctcctggcgttcgaagaagcgcataccgccgtaaatgcggtacggcatactggcctgtaataacgcttcttccagcacgcgcgactgggcgttgctgcgataaaggatggcgcattgcgcaagcgcgccgccgttgtcctgccaggttttgatacgattaaccacaaagcgagcttcatccagttcgttgaaagcgcagtacagcgatatcggttcgccgtcaacgccgtcagtccacagctttttgcccagacgcccgttgttgttttcaatcagggcgttcgccacgctaagaatgttgctggtcgagcggtaattctgctccagacgaatggtctgcgcgccggggaaatcattgaggaagcgctggatgttctctacctgggccccgcgccagccgtagatcgactggtcatcgtcgccgacaatcatcactttaccggtatcgcccgccagcagacgaacccaggcgtactgaatgttgttggtatcctggaattcgtccaccagaatgttagtaaaccgctcgcgatagtgttgcaggatgtgcggcttgttcagccatagttcatgagcgcgcagcagtagctcggcgaaatccaccagaccagcgcgatcgcacgcttcctgataggcctgatacaccttctgccaggtctgttccaccggattgccatagctttggatatggtgcgggcgtagcccttcgtctttctggctattgatgtaccacatcgcctgacgcggcggccactgcttctcatcaagattcatcgccttaatcaggcgtttaagcaaacgcatctgatcttcgctgtcgagaatctggaaatcctgcggcaaattagcgtccatatgatgcgcgcgcagcaggcggtgcgccagaccgtggaacgtccctacccacattccgccctggctggtccccatcaactggccaatacgatggcgcatttccgccgccgctttgttggtaaaggtcaccgccatgatggagtatggcgagttgttttctacgctcagtaaccaggcgatacggtgcaccagcacgcgggttttcccgcttcccgcgcccgccagcaccagcatgttgctacgtggcgcggccaccgcttcgcgctgtttatcattaaggctgtcgagcaggtaagaaacgtccattggcaccgccgcgtaaaaacatgaaaactaaaaacgcccggtggcgcttcgcttaccggggctacttatcgtagggcggataagcatagcgccatccgccagaataactgggaatttatacagaactactggtgattatatcagcgaggtgagagatgccaaccgcgaaatttcgatatgcggcagtaaacggctgtcctgcgtccgcatcaggtcggcattttcaggtttaatccagcaggcctgcatcccacagcgaatagcgccagccacatcggtagtcagatcgtcgccgacatgcaggatctcgccgatcggcacatgcagtttttccgccgccaggaaatacatgtcgctaaacggtttggaacgtccatccgggccggcgcgcagtacaaacttaaagtaatcgccgaggccaaacagttccggctgggcattgccgttagtgatcgccaccagcggccattttttcgcaagctgctgtaacgtctcatgggtagcctgcggaacctcaatctggctgcgccatttggcaaaatgcatcatcgccgcattcgcaccggcaatggactcctgcgccgataatcccgcatcccgcatggcctgctctatcgcgcgatggcgccagcgggtaacgtcatgatagatttccggctccgcttcacgcaccgcctgccgtatccgctgtaaatcgacgttttgaaacgaacgtagcgacgggtgataattttgcataaaagcgagcgcttcctgctcagtacgcaaaatcaccggacggttatcataaagggtatcatccaggtcaaaggtgagcgcggcaatacgccccaaaggccggtaaaaacgcattatttcccccgtttagcgcgcggatgcgccgcgtcgtacactgaagcaagatgttgaaaatcaagatgagtataaatttgggtggtggaaaggttggcatgacccagcagctcttgcacgccgcgcagatcgccgctcgattccagcatatgggtcgcgaacgaatggcgcagcttatgtggatgcacgtggctgtttagcccctgctttatgccccattcggcgaaccgtttttggacattgcgcgcggagatacgcttgccgagcttcgacaggaataacgcctcttcatcgctggcgaacaggccgcgcagatccagccagtgctcaatccacgtcaccgcgttacggccaatcggcaggcgtcgctctttgctgcctttacccattacccacacttctccggtatcgagatcgaggtgctttatatccaggccaaccagttcggataaacgcagccccgcgccgtacatgacctccagcatcgcccggtcacgtacggcgagcggatcgttaagatcgatgtccagcaggcggttaacgtcgtcgacatcaatatttttcggcagatgacgcggcgctttcggtgcggagacgcccttcgccgggttagctttcaattcgccctgactgactaaccagtcaaaaaagcttcgcaatgccgagagacgtagcgccagactggcagggccaagccctttacgccgactgcgcaccgcaaaactgcgcacaatcgcagcgtcacattgttgccagcttttcagcccggtttctccggctaaagcgataatggcatcaagctgacgctggtagttctgcagggtaatggggctaagctggcgctccacgcctaaatagcgcaggaaccgcgagacatccagagaaagcgcgacctccgtcatacgcgtttaatccagcgttccagcagttccggcagcatcagcgcgatctcctgtaaaagctgcgtcccctgccccggctgatagtggtgcgggtcacggctgctgaagagaatcaccccgaggtcgccatcgctgcccatcatcgacatggctaccgaccctacagccttcgcctccggcaagaccaccagcagttccgggccgtttagcgggccaagataatgctgcgactgtcccagtcgttgaatacgcagcggctcgaaggcctgacggtttaaagccagatgcgtatagcgcgatggcgcgccaagacgccaccgatccgggaacaaacgcagcgtcgcgccggcaagccccaaatcgcgcgcccagcggtgaaaccgcatcagcatctcatccagactatccgcggcgaccagacggctttgcagatgcagcaagcgataaaacaggctttcattggcatgagcctgttccatcagcagcgtcatattttcttcaagcacattgatgtgattacgcgcgcgggccatatgccactcaacgagcgaaaccgttccccgcacgggatgtggaacacgcatcgcttcaacggcgtgggcgttacggataaaaaactcagggtggtggcgcaggtaatcgacgaccgctcgatcgtccagttccgtgagcgtttcctgtagttcttcctctggttgcttcataaatggataaatccgtcgtagatatgtgccgccggaccagtcatgtataacggatgacccggacctttccaggcgatatccagccgaccgcccggtaattccacgcgtacttcttcagccagcagcccctgctgaatccccacggcaacggcagcgcacgcgccgctgccgcacgcgcgggtctcccctgcgccgcgttcatagactcgcagccggatatgctcacgtcttacaacctgcataaaaccaatgttggcgcgttccggaaaacgctcatggctttccagaaccggccccagtgtttcaacggccgccgtgtcgacgttatcaacctgaatgacacagtgcggattgcccattgaaaccacgccgcacagtatggtctgttccgccgctcgcataatatacgtcttttccgctttgttggcgcgaaaaggcacctgcgcgggttcaaagtttggctcccccatgttcacccgcaccagttcatcttccgtgacgctcagtaccatccggccattcgcggtactgacccgaatatcgcgtttattggttagccctttcaggcgaacaaatcgcgcgaaacagcgcgcgccattgccgcactgcgagacttcactgccgtcggcgttgaagatgcggtaatgaaagtccaactcaggatcatagggcggctcaaccaccagcagctgatcgaaccctacgcccaagtgtctgtcggatagccgacgaatcagttccggcgaaaaaaagacattctgcgttaccgcgtcgacgaccataaaatcgttgccaaggccatgcattttagagaattgcatcattcactccgttcacgcggggacagaaaactatcctcagtaattgacctgggacgggccatctcccgttgcgcgatcgttcttatcgggcatcgtggactgcgtttgcgaatcgacttttttcgtcggcggcggcgcatttttatcggctggcgggaaataaagcggccctttcaaaccgcagcccgtcaggctgaacagagtcagaagtacagcgagtgtcttaaacacgtttttcattatggattgcctgtaagttcatgctttctattttctatcatcgcaggagaaggagtaaaagcaagcgtttaggggctctttataaaatctgaaaagcggcgcgttgccatgattattgcgcatttacatcaggaaacatgctttgctcatcactttaggtttacgtaccacgtccggatgaccttatgcaatatcgtaatttgttttgccttttttcgctttcacttctgctgcctcccgcttggggatgccggctgagtgaacctccgcacaatgtttatcaacggcaaggcagcggcgtggtttatctccagccagaagaggagaacaatctttcgttgccggaggtgaatttcaaacgcctgcgtcggttacccaattcattgattaacccggcaactcaggatgagtgggacagggaaccgccgctcaccgacctgacgaccgattacgttcataccagtgcgcaggctatcttcccgcgcttttcctactacagcgacggacgcgttattctgtacggtggaaaaatcatgcgtaatccgccggggacgccatcggtagatgtcgcctcatttcgcgcctttggcaaagtcggcgttgataaaaatagtctctatgacgaaggcaaacgaacggatgacaacggcggcgaaaaccgcgttaatttacagtcattgcgtaaggttgaatttagcagccagtggaaaccagacctgttgggcttgacgctgcgcgacgatcgctttctttatgtcgacgggcatcgcctgagcgacccggacagtttcaccgttctggcgcaaaagtcctgggatcagcgcggtaaattttccgccacatttaatccttgtatcgccgtcccctttggtccctgggatacgctggcccgcacacgcaccaaaatcatcatcaacggcgaccaactggacgccgacccagacaccttttccgtggtgcgctggatgcccggttctctattgacctggcgcgataaaaacggcttgcaccgtcacgttctcaaccagaacaatctgaattgggacatgcaaattgaaaaacactgtgatgcgttcaacctgcaggaaaaacgcgtgctgtggcgtaaaggaccgggatgcaaatttgccgaaatccccggccttgacccagaacagtttcatccgctcagtaatgcggtggcgcagtctcaggatcggctttatgccatcaggaaaacggaattcggcgaaaaccaactggatgtcgtcacgctggataacccaaatctggtaatagacaagcgttttaatgccgggcggtatcacggttatttactcactaaaacgcgatccgactttaaggaagaagacggattgcaggtattcgagtcggctggcccgcttattctgatggactatcacgttccggacgagacagaagcgcatctgggcgacagcccacattacaaaaaatggtacgcacgcgacgatcgctatgtttacgcgtttgatggcgctcaactgtggcgctatcccacgcccaatcccaaagctctacgcatgaaatggcaaacaacacactcaggatacggctattgggtggattaccgcatagcccagttagatggcgctctcatggaggatggctcttttatcgccacgggtatcccgcgcgatccttccgtaaaaacagcctatgctaaaaccgatggcacctttgacatcggcaaaacagcggttcgctggcgcaaggttctgtcacctgacggtgagtggggtcgttggcaaaccattcccaacgttgacccgagtcagtttcatctggttaacgatcgcatcgcgcaatataaggaccggctatacattgcgaggctctcaccttttggcgaagaccagttggaaacgctggaactggatagcacagcccccttcctgaaccagaaaattaacgccggaaaagagcacggctactttatgcataatagccagcaggctcaggatattcaggtctttagcatcaatgggccgctaaaagtcaccgagcgttttgcgtatgacaaccgctatgtttatacgtggattggtagccagatttaccgaacagcatccctctgcccggataagacgctcaatttgaatcagaatatgtactccgacaataaagacatcatcatcataacgcaggcgcaggaatgccaaaaatcacgtcgctaagccgttttgcgcgcttgattaaacatttgaaaaacgcccttcggggcgtggggatcggttcatgcatttacgtcattgttgaaagcgttatgcacggcacgataaacggtgttgaagctgccggagtcctgacgataagcgcggtactcggtctgcttagcgctcttttggatatcaaagcaaagccgcgcgcccccttaatcctgttgcattttctcctctgcggcggctgcgtcgcactgatggtggcaatgctgtcggttctgaaccatttcccggttaatgcgtccgtcatacttatcaccagtgcgctatttatcgtcatttatctaccgctgggttttatcctttaccgctcacaacggtaattcgtatcggttccagaagctgacgcttccccttatactggcgctatcactcaatagcgggataaaacaatgaacgacagtgaatttcatcgcctggctgacgccctgtggctcaccattgaagaacgccttgataactgggacggcgacagcgatatcgactgtgaaatcaacggcggcgtgctgaccctcagctttgagaacggcagtaagatcattattaaccgtcaggagccgttgcaccaggtgtggctggcaaccaaacagggcggctatcatttcgatctgaaaggcgacgagtgggtttgcgatcgcagcggcgaaacgttctgggatctgctggagcaggcggcgacgcagcaggcgggtgaaaaggtgagtttccgttaagttttcaattccgcaggagagccagaagaatagcgctttcctgcgtatatttaacgagatatgcggtcgtattaccaaccccggaatgtgaaatacagccaggttgccagaaacaacgcgggccatacactcaaccaaccaacccaaaaaccgtagcgttgccaaaaggttaggttaaatagtgacttctgctcggtaaaaagttgacgtaacgctggtgaccaacgtttttccttgatttcattgctgcaatgattgcatatcgctaaaccaaacttatctctttttctcgcttgagacagaccacatgtacgggtccttttttggcgaataatcaaccatacatcctgattattacaataagggcatgtttcatgtgtgggtagggttgccagaggcagcacatcaatatggtgagtaataacaaaaaacatatatctctaccctattgttccaggtttctggcaacagccattttaaaaatatcctgtaactcatctgaatcataatcgagatcgtttagagagatattcatcacgcgattacttccatgcttattcaataatgacagaaaattattacgcattttctcattagtaattcgctgacaataaagctcaatatctttgacaaaaatggccagcacaggcgtattatcgctaacacgctcaccaacatagtcgatttcatgccagtaaactattggtagcctggttgtgtgtaatgttactccctcctggttcaacgttagctgtggctttcctgaaaaggcggagtaccagtaagcacttgcgcctgctatcatgaggattatgaaaaaaacacacatcatctttagcataatactataatttagaaagaggctcatcataaaaactatagctaacactgaataaaacagagctaattttatttgtcgtttcttattcacgtaaataagaatagggttgtttattgacatataatatccttttataaaaacatccataagaaaccattaaagagcttttgtttctaatatagtttttcaaaacatatttacgaaaacaatgaaggacgcgatagcattttgaacggtctgaatattactacataaattgtataagaaaaaatattatctaaaccttgttccgctcaatgggcattcttcgaatgtaggctggataaggcgcgttagcgccgccatccggcacagtatcgctctaaagccataatcatattgataagaataatgaccacacatgtgagcattaacgcggtaaaaaacaaaaaggcgataccgtacaatccccatcccaggtcatagagagaatggtaattgtcgcaggagatgatcacatccaggccggggcatacttttccccatcgcccccagtaagacgcatcccagagttgcaaactggccatgctggcgcatagcgagagcaggcacccagcggatataaaacagaataacttatttataagaatgaagccgaggctgaccatcgccatgactatccctaacaaaatgaacgcatctgccacctcaaacctcctcctgtaaaccaaatgcggaggtcacggtaacgaagttgggtgaagttaatgtgaagcggtgaacgccggccgggcagcgttgcccggcgcagcacttacgaaaaatactgctgcaatagcggcgcgtcatgatcctggtttgctggcggcacggtgttgataggctgcgtacggaatgggatcacctgcgcgcggccatcggttttcactatctggtagaactgcggcaggttgaagttgataaagctggagccatacgtgaagcgatcgtgcgatgacgaatagaagcgactgacgtcgcgcaccagttcttccttgctaccctcgcagtggtgatacacttccgcccggttactttcatccagaatataaatattaaagcctttctcatcgcccgtttcttcaaagaagaactggataatcccttcgctggcgaagccatccaccactgacggcaatttcacctggttggtttccacctgtaccgacagcccgtgcagcttgttatgcgaaatcgcgccgtagaattcgatagcgttctccagcttctgcaccgagacattcaagcgttcgaagaatagtccccacgtctgcccggaaacccgcagcgccttgaagcgaccggtctcctgacgggtgctggaaagacgtagctcgatacattcggagaccagttgctgcacgcgggtgcgaatcagaccgcgaagatgctgactgtaacagaacacctccacgctatccggcggcgcggcatcctggtgcattttccccagaatcgttttcagcgcttcgatcatcgcctgctcgccgttaaagtgcagagtacgcacttcgttccacgagttgcgatataacaagtcgatactgcctatcagacagttttgctcttcgccaaagctgaaaacgtccagcttacggaagtcaaaatgaaccactttattgcgaaacgccgccgtcgggtcatattcgaggttaacgataatcgccagatggcgaatttcacaggggctgtagagcgctttcggcgttggagcaggcaagcgcagcgggaaatggtgcgaaacatcggcgaccatctcctgcaacttaggcaggtcgacaataccgttgcccttaataaacagatgcgttcgcgacgtcagcaggccgttgaaccacgcccacgcgaccagcttattaagataacggttatattccagcggctgatggctgatgatggaatccatgttcggcgcgcggttgtagagataccagcctgaacggttggcacgtcccggcggcacatggataaaggttaaattcggctcggacagatccggcgatatctgcgggttcaccagcgtgactttacccggcaacgcttcaaacgccgcgtacagcttacgcgtcagtacgccgatatcctgcgggctggcactcacgctgaggttgttgcgccgcgcaaagcgaatcagattacgatagctttgcatcattgcgtcgagcaattcgttgtgggcttcgcgcacctgatcgattttccagtttgcgcgattatcgagcatggtcagacgcgcgtcgtcccatccccactcgctgaccaactggcttaatacttcccgacgccagcctacgcaggcgcgctcgcgacttaatttctcgcacactttcaggtaaaagcagcggcggactaaatccagccgcgtcggatcttcaatcgccgtcaggtattcagtgacccgttccagcatcatgcagtagggatcgagtccaaacgatacgatttcaccgtcatgcagacgttgtttaatatctttcgccagcagacgtgggttggggtattcccatgaataggcttccagcaacagcgttttcagcaccgctttgtacggcgagtcaatgctcttgtatagctgccacaggctggcgccaaagtactcttcggcggagagcgagcttaagccccccaaatccagccattcgtttggcgttaatacgccctgcgcgtagagcgtcatgacatagtcgtcgtaatgctcttcttcgtcgcacggcaccatactccacaggatacgcttcccggccaggcgcacagcggtacgataaaactcatcaagcaacaggatatgctgcgtagaaccacagtcttccccgcccagactgccgctttcgttatggcggaaacggttctcgtcaatcaggaagaagctcacctcaacgccaagcgaggcggcccagctttccagcaggctacacttacgttgcagcaactgacgctcttcgccgtcgagccaggactgatggcacacccagatatccaggtcggacgagcagctctgcccgaccgaggaggtgctgcccatggtgtaaacgccggtaatcggcaactcgcccttcggcggatcctgcggcgtcataccgcggtacagctcaagttcgttcagatagtggcgttgggtttcatcaggcgtgtagaagcaaataccgctgggaacgttaccatcaaggtaacccggcatcagtggatggtgatagtgcaataatgtcggcagaagactgtaaacctgctgaaaagcgggtcccatggcagcaagcgcgcgatccacacgcagttgatttatggcatccagtctctgtttcagagtctcaatatagaggtacaagacgtatcgcctgatgttgctacccgtcatggtgcaggtcaatacttcaccgtcgccattcgggataaaccgtatgtcaaaaataaccgttaccctttctcgcctgcatatttttatctaataccgacgaaaaaatggtctaaaacgtgatcaatttaacaccttgctcattgaccgtaaagaaagatgcgctacatacaagtgtagcaccgttcgctgcgtgtaaattcttaaatacgggctggcggtttctcgtcattattcactgtcattgacgacactgcgccttatcctctcactcacggtgaccggaaaactaacatactctctataaggatgttaggatggtcaatgattgataatgacggtaacaagcatgttagacaatgttttaagaattgccacacgccaaagtccccttgcgctttggcaggcacattatgtcaaagacgcattgatggcaacccatccgggactgacggtagaactggtgccgatggtcacacgcggcgacgtgattctcgatactcccctggcgaaagtgggcggtaagggactgtttgttaaagagcttgaaatcgcgctgctggaaaaacgcgctgatatcgccgtgcactctatgaaagacgttccggtggccttcccggacggtctcggtctggtgaccatttgcgagcgcgaagatccgcgcgacgcgtttgtctcgaataaatatcacagtctggacgatctgcccgcgggtagtatcgtcgggacgtccagtttgcgtcgtcagtgtcaactggcggaacgccgtccggatctcattatccgttcgttgcgcggcaacgtcggcacacgtctcggcaagctggataacggcgactatgacgccattatcctggccgtggccggtctgaaacgcttaggtctggagtcgcgcattcgcacagccttgccgcctgacgtttcgcttcctgccgtaggccagggcgctgtcgggattgagtgtcgtcttgacgacgcgcgaacacaggcgctgctcgcaccgttgaatcactcgcaaaccgcgctgcgcgtaacggcggaacgtgctatgaacacccgcctggaaggcggttgtcaggtgccgattggcagctatgcagaaatcatcaacggtgaaatttggctacgcgcgctggttggcgcgccggacggttcggtgatggtgcgcggcgaacgtcgtggttctcccgagcaggcggagcaaatgggcatctcgcttgcagaggaactgctggaaaacggcgcgcgcgcgattctgacggaagtttataacggcgagacgcccgcatgagtattctgatcacccgcccctctcccgcaggggaagcgttagtgagccgtctgcgcgcactggggcaggtggcctggagttttccactgattgaatttgtcgccggtcgggagctacccaccctggccgaccgcctggcaacgctgacggaaaacgatctggtttttgccctttcacagcactccgtcgcctttgctcacgcccagctccagcgggatggacgaaactggcctgcgtcgccgcgctatttctcgattggccgcactacggcgctcgcccttcataccgttagcgggttcgatattcgttatccattggatcgggaaatcagcgaagccttgctacaattacctgaattacaaaatattgcgggcaaacgcgcgctgattttgcgtggcaatggcggccgcgaactgctgggcgaaaccctgacagttcgcggagccgaagtcagtttttgtgaatgttatcaacgatgtgcgaaacattacgatggcgcggaagaagcgatgcgctggcatactcgcggcgtaacaacgcttgttgttaccagcggcgagatgttgcaacgactctggtcgctgactccccagtggtatcgtgagcactggttactacgctgtcggctattggtcgtcagtgagcgtctggcgcacctcgcccgggaactgggctggcaagatattaaggtcgctgataacgccgacaacgatgcgctgttgcgcgcattacaataactctcataatgggatgccataatgacggaacaagaaaaatcctccgccgtggttgatgagaccagggagaccgtggaaaccacgccacagccagttaataccgagaaaaaaagtaagaacggcgccgcgctggtattaagcgcggtggcgatcgcgattgccctggcggcaggtattgggctttatggctggggaaaacagcaggcaaccgcgcaaacggaaaccagcgatgcgctggcgacgcaactgaccgccttgcaaaaggcgcaggagagccaaaaagcggagctggaagggattatcaaaaaacaagcggcgcagttagatgacgcgaatcgccaacaggcggcgctggcgaaacagcttgatgaagtacaacaaaaagtcgccaccatttccggcagcgatgctaaaacctggctgctggcacaggctgatttcctggtgaaactcgccggacgcaagctgtggagtgatcaggacgtcactaccgccgctgcgctgctcaaaagcgctgacgccagtctggcggatatgaatgaccccagcctgattaccgcacgacgcgcgattactgacgatatagccagcctgtcatccgttgcgcagatcgactacgacggcattattctcaagctcaatcagctctctaaccaaattgataacctgcgtctggcggataacgataccgatggttcgccgatggattctgacagcagcgagctgtccagctcgctaagcgaatggcgcgttaacctgcaaaaaagctggcagaactttatggacagctttattaccattcgccgccgcgatgataccgccgtaccgctgttggcgcccaaccaggacgtctatttacgcgaaaatattcgctcccgcctgttagtcgccgcgcaggccgtgccacgccatcaggaagaaacataccgtcaggcgctggataacgtttcgacctgggttcgcgcttattacgatactgacgacgccgcgacaaaagccttcctggaggaggtcgataaattaagccagcaaaatatcacgatggatctgccggaaactctgggaagccaggcgattcttgaaaaactgatgcaaacccgcgtgcgtaatctgctggcgcaaccgacagtctctacggcagcgcctgccacgcagacagacgctccggcagccgcgccgcaaggagaataatgatgctaaaagtattattgctctttgtgttgttgctcgcgggtatcgtggtcggcccgatgatagccggtcaccagggctatgtgttaatccagaccgataactacaacattgaaaccagcgtcaccggcctggcgatcattctcatcgtcgctatggtggtgctattcgccattgagtggttactacgccgtctgtttcgtaccggcgcgcacacccgcggttggtttgccagccgtaaacgccgtcgcgcccgcaagcagaccgaacaggcgctgctgaagctggcggagggcgactatcagcaggttgaaaagctgatgtcaaaaaatgccgaccatgctgaacaaccggtggtaaattatttgctggcggcagaagcggcgcagcagcgcggcgatgaagcacgcgctaatcagcaccttgaacgtgcggcagagctggcggggaacgacaccatcccggtcgagatcacgcgtgtgcgcttacagctggcgcgcaatgaaaatcacgcagcgcgtcacggcgtggacaaactgctggaggtcacgccgcgtcacccggaagttctgcgtctggcggagcaggcctatattcgcaccagcgcatggagttctttactggatatcatcccatccatggcgaaagcgcacgtcggcgatgaagcgcatcgcgccatgctcgaacaacaggcgtggataggactcatggatcaggcgcgtgccgagcagggcagcgaaggattacgcacctggtggaaaaaccaaagccgtaaaacccgccatcaggtggcgctgcaggtcgcgatggccgagcatctaatcgagtgtgacgatcatgatatggcgcagcagattatcatcgacggtctgaaacgccagtatgacgatcggctggtgctgcccattcctcgcctcagaaccaataatccggaacaactggagaaagtgctgcgccagcaaatcaagacggtaggcgatcgcccgctgttatggagcacgctcggccagtcgctaatgaaacacggtgaatggcaggaggcgaccctggctttccgcgccgcgctgaaacaacgcccggacgcgtatgattatgcctggcttgccgatgcgcttgatcgactgcatcaaccggaagaggccgccgccatgcggcgcgacggcttgatgctgacattacagaacaatcccccgcagtaattccctcttgcccggtggcgcttcgcttaccgggcttaccgcctacacaaaatcattcgggatgcataaaaaaacgcctgcccggttaaggggcaggcgtcaaaacaggtctgtatgacaacataaaggggtgcttcactcaacgttgtgtccagggtgtttgatgaggcgtaagcgacatctgtcagtggacgataagcaccgtaaacggctctgcatcattcctgagtttatgaggccagaaggcgaacataagagatggaatgagcatctacccgtacattattgcacataacgtgccatctttgcaccgctaaaaaacaggcgcaggcattaaaaaaacgtagagaattcacgcgattgttatccccccgccgctggcgaggttttagcgtgtcgcccggcggagacagaacaggatgctttttataaagtgattataaatcaatagattattcgtcaccgaatagcgacaaatgaagtctgggatatcgccaataaaccataatggcaacacgtgcgggataaggggttgaaaatgaacagaaaacaaaaaaccccgccgaagcggggctcaaaattggtcggcgagagaggattcgaacctccgacccactggtcccaaaccagttgcgctaccaagctgcgctactcgccgatatactgcttttttgaatttttagttcaattcattgagtcgtggtgcgaggggggggacttgaacccccacgtccgtaaggacactaacacctgaagctagcgcgtctaccaattccgccaccttcgcgtttcacaactctatattaatggggtggctaatgggattcgaacccacgacaactggaatcacaatccagggctctaccaactgagctatagccaccactgaaactttttacgcggtattaaaccaccgcagctcaagcacctaaataaatggtacgcccgacaggattcgaacctgagacctctgcctccggagggcagcgctctatccagctgagctacgggcgcttagcgccgttgcgggggtggataatacggacttcacaccccgctgtccagtgcctttttaaataaaatgcgcgtttggttatgctttgcgcattttggcgcttattcccccaccttgtgggcggttccgtgacgattcaggccgaaaactttgtagaccagcgtgacggccagcaggaagatgacgccgacaaacagcgacatgcgcgtatcttcattaaagtacatgccgattaaaacgcaaaccagaaacgccatcgtcaaatagttcgcccacggaaacataatggaacgaaaaggatgatccgcaatcgcttctttatgcgcccgacgaaagcgcagttggctaatcagaatgacaaaccacggcaccatccccggcagtacgctggcgctataaacgtaaacaaagacgcgctgcggattggggataatgtagttcaggcaagaacctaccagcaaaatcaaaatagagagcgccacgcccgcgaccggcacgccgtggcgagagaccttcgcaactgccgccggcagttgacggtttttcgccagcgcgtaaagcatacgcccacagctatacattccgctgttacagccggagagcgccgccgtcagcacgacaaagttgataatgcctgccgcggcggtgatgccgattttcgcgaaggtgagcacaaaggggctgccgttgctgccaatctcattccacgggaaaatggtgacgatcacgaaaatcgcgccaacataaaaaatcaggatacgccacagcactttacccaccgcgctacgcaacgtcacctgcggattcttcgcttcaccggcggtaataccgatcaactcaaccccttgataagaggccaccacgatacataatgcggtcagaaagcctttccagccgccggcaaaaaagccgccatgctcggtcagattaccaaagccaatcgcctggccgccgttaccaaagccgaagaaaatcacccccaggccgatgatgatcatcacaataatcgtggtgactttgatcatcgcaaaccagaactcgatttcaccatacaggcgcaccgcagccagattcgccaacgcgaccagtccgacggcaatcagcgccggtatccactgcgccatctccggaaaccagaactggacgtagaccccaatggcggtaatttccgagatcccgaccgccatccacataaaccagtatgaccaggcggtaagatagccaaaaaaaggactcatataccggtgggcgtacacggcaaaggagccggtaacaggttccagaaagagcatctcccccatcgaacgcatgatgaaaaagacgaacaatccggcgatgatatacgccagcagcactgacgggcccgcccatttcagcgtactggcggcgcccataaagagtccgacgccgatggtgcccccgagggcaatcaattcaatatgacgagcttccagcccacgctgtagctccggttttttctctgccataaatcctcatgtcgtgtttgcaacggttccggtagtaccggttattgttatgggtacatcgattgttgcgaatattttcttaaatttggacaaatggcaaatgaagcattaaaaaaatgcgcttattgtgtaagaaagcatcgattatgttgtaaatgagcagagccataagcacagtccgctgctcaagtcatcagaagggagaatcagagatcgccagtatagtgccagcgaagatagcgcagcagacgcatctggcgggtaatacgcttcggttgcgaaagcagacgatacaaccactccagccccaggttctgccatatttttggggcgcgtttgacgtgaccggtaaacacatcataggtaccgcccacccccatatatagcgcatggggatgcacttcccgacaatcgcgcatgagtaattcctgttttggcgatcccatcgcgacggtgacaattttcgcgccgctggcatggatacgcgcaaatagcgcctgacgctgctccggcgtaaagtaaccgtcctggctacccacaatattgacgttccactgcgtccgcagttttgcttccgtctgcgccagcacctcaggcttgccgccgacaaaaaataccggcgtgccttctttccccgcgcgcgccattaacgcttcccaaaggtcggcgccagccacgcgagaaacctgcgcctgcggaaattttttacgtattgaacgcaccacgctgatgccatcggcatatttaaattccgccgctgctatcaacgcgcggacttccggattatcttccgccgtcagcagcttttcggcgttgatcgccaccaacgtgccttgcttcagttgaccatcggcaaacagataattcagcgcatgtgacatgtcgcgccagccaatcagaggtaatccacgcagcgagtaaaggggcgcagcggcattattggtcatagttttccatccatctgtgcctgagggagcgaagttgtacgtttatgaatcagtccggcgctatcaaataaccagaacagaagtttagcgaccagcaggctggcgccaaaaaccaccaggaagaaaaccacgcgcgaaacaaacgaatccagcccttctcgcgccagcacaatcatattaaagatggcgccaaagcagaaactgtgcagaatcgccgccttatagcgattgggttcccggttacccagttcatacagccagtcgaaccatttgataatcagcccgacgacgatcgcgccgagcggaataaacagtgccccgcccatgaccaccagcgatccgataagcgttggcgatatcgccaagccagaatggttgttcaggacttcccaggtgaagtaattcgcagaattcagcacgatactgggtcgtcccggccataaccaggtaggaataaagacgtagaaatcacgcacgataggggccagcccctgaaaatcgatattgtggtaattttgcaacagcagcgccagattctcccacggcgaaaaggtatcgcgcgtcagataaagaaacgtatagaacgcctcatcgccgctcacatttaatccgtagcgtttgagcgccagccagaacataccgacaatccccagcacgcccgccgctgccagcatccacaggctgatccagccccgaataatgccgataaacaggaagatagcaaacgcaataatgatgttggcgcgcgtgccgccgacaatcatgtaggtcaacagaccaaacgcgacggtgctcaccagaaagaacagccacgctttgctgtcctggcgcaggaaatagaccaccagcatcgccggaatgaagaaatagaagaaccgttttaacgccacgccggaaacttcgctggaaaagatctggctgtaggagtgtagtcggaacagcaaaaagccgttatgcataaagaaaatcgccacgctcaccagcgcgatgcccatcaggatcacccaggtaaggtgggtttccacccggttcatggtaaatagcggcttgcgtggtacatccacaacgcgtttgcgtaaacgcgttttataggtcacgtaatacacgccgtagaaacaggcggcggataatagagcctgcaataagatttccggcggcgcgacgccaacgtcgaaacgaaataccagcacgctggttagcggaaaaccaaaaaagaaggtcaacaaaaaaagcaacgaaaagaaaacgttgaagttaaaacgcacgcggcggaattcaaaccaagtcagcgtggcgataaacagcgtagagagcagccagaccaccagcagcccgctgaattgcattaaactcattcggcttctcctgcggcgattctcaacgcattatgccacggttgcaggtagttggggctaaagaaggtgatgccgcttttatctaccgatgcgagctgacgctgcgcctcgcgcacgacctgctcattaagatcgtccgtggtaaacaggacgggcagatgctgttccgccatatcctgccagaaaggattgtcgcgattcaacacgcacgggatatcggcctgaattagcagacacaacgtcccgatcccctgttggcgggcaaaaataaaataaccgaggtcgcactggcgcaacagcgcaagataggcatcaaattccattttttcgctaagaatttgtagattttcggcgctaaatagcgccagaccggcctgacgaacctcatcaatataggcctggttattggctggatagcccatcggcaccaccacgtttaccgtgtcgccaaactgctgatacaccgcccgtaacgccgcaatatgttggttactgcgatcgccggagttccctaccaaaatggtcaatttccccgcacgttggcgctcttttgccatagcattcagagaaggatccatgcgcgtcgggaaatagagcaactcgccgcgtacgcccgggtgctggcgcgcaaaatagctgagatcgccgcgcgtcgcgaatacgccccctactcgcccctgcgcgatacgacgaagcgggtagaaaaggcggaatttcagcccgttggacacttcgtagagatccgcgccccagatatgccagtaaaactgggctggcttaataccgccgcttaacagcgccagccacagactgatgttgaactgcccgtgaaagaagaatctctgtcgacgatttgctttcgctttggcgataaccgcctgcgccagcgctttcttactgccataaaaacgaagcgagagtgccggacagctttccgtgaagccgttatcttcaccggcaaccataaattcgcgcgcgtgctcgcctgtggcggccagcgtatcattgaaaaaccgcagcacggtgtggttatggtgagggatatccgatcccaagacgtgaatcagtacagtcatgctcgcctacgccagagtaaaaatacgccgcaacaaagtgaaaaatagacaatataggtggccatataagcctgtgccgcacccagcgcgccgtgagcgggaatcagccagtgagcgaacgccgttaacagaatgaactggctaatttcggccagaatgtaaaatcgcaacgacgctttggcaatcaccagataaccgaaaacataggcgccgactttcagcacgtcgcccactaactgccaagcgaacagatcgcgcatcgcggtgaatttggcggaaaaaagcagccagatagcaaaatcgcgcaatagccagacggtaaaactcgccgccgcaaccgccggtaaaacaaatttcagcgcttttaccacttcacgcgtaatgtcctgtttttccgtcaggcgtgagagcgtaggtaacaggtaaacgctgaaggaggcggtgataaattgtagataggcatcagaaatactgctcacgccctgccagatcccgacatcgctccagctatagtgcgcggccagttggtttcgtatcatcacataggcgaccggcatcgtaacagaggtaatcagcgtcatcagggtaaatttactgagttgccctgccagaccgttgtcccaggagggcttgagatagcgtagcgggacggtgccgcgcttaatcagtattataccggctggcactaccaccagcgccggcaccagcgccaggccaagcagagcgccttcatagccgccgacacggtagcagagataccaggcggcgacgcccaaaaagctgccgacaattaacgataaggcattacccgacgcgtcacgaaagcccttcattagcgccagcagcaggttcgcccaggcgatccccatttgtaccagcgcaaccagacgcaccagcccttgatagttcgtatgaccgaacagtccctggctaatcggcgccgccgccagcaggaagaccagcgccagcagcgtagagaaccccaataccatcgcggaggaggttcccaccacggtacgtaactgcgccgggtcatcatgatgttgtgcgacgagtttggtaacgccgttaaatatcccggcgccagccaatacgcccagcacggtaatcatctggcggaagttacccgcttgtccgacgcccgacggaccgaaagagacggccagtagtttcaccaccagcagtccggcgccaatttttaccagcgtactgaccgccgtccacagggaggctttagcaagcgacatatcaggagaaataatttagcaaggtagtaatcaccgttcgttgatcgacgggcgcaaggttataaaacagcggcagacgcaacaaacgttcgctctcttttgtggtgtagacatcgtccccgataaactcgccgaatttatcgcccgccgggcaatcatgtagcggaatgtaatggaataccgccatgatttccgcctctttcaggaaattaatcagcgcgctgcgatcggcgatatcccgcagtttgatgtaaaacatgtgggcattatgcccgcagttttccggaatagaaggcagctcaatacgcccggcgcgcgccagcggcgttaacgcatcgtagtaagtctgccacagcgacagacgctgttgattgatacgatcggcggcctccagttgcgcccacaggtaggcagcctgcagatcggacatcaagtaactggagccgatatcccgccaggtgtatttgtccacctgaccacggaagaactggctacggttggtgcctttttcgcggatgatctccgcgcgttcaatcagcgtacgatcgttgatcagcgtcgcgccgccttcgccgccagcggtgtaatttttggtttcatggaagctaaaacagccgatgtgaccgatcgtccctaacgcgcgccctttgtacgtggacattacgccctgggcggcgtcctcgacaacgaacagattatacttatccgccagcgccatgatgacgtccatttcacaagcgacgccagcgtagtgtaccggcacgatagcgcgggttttatcagtaatcgccgcctcaatcagcgtttcgtcaatattcatcgtatccggacgaatatcgacaaacacaattttcgcgccgcgcaggacaaaagcgttagcagtggagacaaacgtaaagctcggcatgatcacttcatcgccgggctgaatatccaacaacagggccgccatctccaaagacgcggtacaggaaggcgtcagcaacaccttcgcgctgccgaaatgttgctccagccactgctggcaacgacgcgtaaagccgccgtcgccgcacagtttgccgctgctcattgcagactgcatgtattcgagttcggttcccaccaccggcggcgcattaaaaggaatcatgttgtcacctgtataaccagtacgcagtgctttcgatgttggcaccgctttgtatgtaacgtttaagcgcggcggtgttgcccaactgggtcgccacccgcaatgttgctttgccgcgactctgcgcccaacagatcgccgcctgcataagttccgctcccgcgccgcgtccggccaacaggccaatgcgcacgtcggtatcattcaattcccgcagcgagacgtaaccacggatagcgcctgtctccgtgcgaagcaccaggcattggtgatcaaacgtgccgcgtaccgcattctcaatccactgggcgtaaaaacgggcgctggcgtcgggcgcataccacggcgcgcgaaaacgactctgcgtaaacgcctctccggccaactgacgcaaagcaggaatgtccgtaagatgtgcaatttccgcgccatgctggtcgcgatgcccttttaccggcaacgcaaaatccacctcgccttcaaccaaagagaatcccagcgattgcaacgccgacagccaggcgatgttttcagccggcacttttgcctgcacgcgttgccatgcctgcagcgcttctggcgttaattcgggcgctgaggcatcgatacgcacaatgccgctattcacgccaaagaacgtattttcccagtgtaacggttcaatactggcgcggacgggcacggagcaactccagtaaatattggccatagccggttttttcaagctgactggcggcgcgtttcaaaccatcatcatccagccagccgttgcgccaggcaatctcctccagacaggcaattttgaagccctggcgcttttccaccgtctgcacaaaagtgctcgcctcaatcagactgtcgtgggtgcccgtatccaaccaggcgaagccgcggcccagcagttcaacggtcagcttaccttcctccagatacatctggttgatagaagtgatctccagctcgccacgcccggacggtttcacgcgcttcgcatactcgacgaccttgctgtcatagaaatagaggccggtgaccgcccagttagatttaggctgtttcggcttttcttccagcgagagcgcgcgaaaatcatcgtcaaactccacgacgccaaagcgttccgggtccatgacctgatagccaaatactgtggcgccttcggtacgcgccgcgacctgacggagtttggggctaaagccctgaccaaaaaagatattgtcgcccaatactaggcatgagggttcaccgttgaggaacgtttcgccaatgataaaggcctgcgccagcccgtccggactgggctgctcggcataatgtaaatcgataccgaatgctgcgccgtcgcccaacaaacgctgaaagtcgcgtttatcctccggcgtggtgatgatcaagatctcacgaatgcccgccagcattagcaccgataacggatagtaaatcatcggtttatcgtagacgggcagaagctgctttgatacgccgcgcgtaatgggatgcaaccgggtaccggaacctcccgccagaatgatgcctttcattcgtttctcctccaggagtaagagcctgccgtttagcgtttcagacctaagcgttcgccctgataactgccatcctgcacgggtttccaccaggcctcattggcgagataccactgaacggtttttcgcatcccgctttcgaaggtttcctgcggcgtccagcccagctcgcgggcgattttcgacgcgtcgatggcataacgtaagtcatggccgggtcgatcgtcgacgaaggtaatcagatcgtgataattcgccacaccctgcggtttttgcggggccagttcctccaacagagcgcagatcgtcctgaccatatccagatttttacgttcgttatgaccgccgatattatacgtttcgcccaccgcaccgttcgtcaccacgtgatacaacgcacgggcatgatcctccacatacagccagtcgcgaatttgctgaccgttgccatagaccggcaatggtttacccgccagcgcgttcagaatcatcagcgggatcagtttttccgggaaatggtagggcccgtagttattagagcagttggtgacaagcgtaggcagaccgtaggtacgtaaccaggcgcgtatcagatggtcgctgctggctttggaggcggaataagggctgcttggcgcatatggcgtggtttcggtgaagaaatcgtctgcagtatgcagatcgccatacacttcatcggtggagatatggtggaagcggaacgccgctttagcgtccgcgtcaagcgcggaccagtaagcgcgagcggcttccagcaaggtgtaagtaccaacgatattcgtttcaataaacgccgccgggccgtcgatggaacggtctacatggctttccgccgccaggtgcatcacgctatcgggctgatactgctggaaaacttgctccagtgatgcccgatcgcagatatccaccttctcaaaggcgaaacggtcgctttgcgccaccgacgccagagacatcaggttgcccgcataggtgagtttatccaccaccaccaccgcgtctgccgtttcatggatgatatgccgcaccaccgcagatccgataaagcctgcgccgccggtcaccagaatgcgtttcatcagcgccagacccctttggtatcaaccacataacgttgatgaaccgcatcgccgggaatcgctttaaattcgtcgtgatcgaccagcatcaccagcacatcggcggcggccagcgccgcgtccagtttcgccagcgtgcaaagtccgtccaattttttcggcaactgacggatattcggttcgacgaccagggtttcgccgctgtgccagcgggcgatactttgcgcgatccccatcgccgggctttcgcgcagatcgtcgatattcggcttaaaggccagcccaaaacaggcgattttcacttcgctggcgcgtttatcggtggctgccaggcaatctgcgaccgcggcttttacctgatcgaccacccagtgcggtttgccgtcattcacttcacgcgcggtgcgaatcagtctcgcctgctgcggattttgcgccacaataaaccacggatcgaccgcaatgcagtgcccgccaacgcctgggcccggctgcaaaatattgacgcgcggatggcggttcgccaggcggatcaattcccagacgttaatcccctgttcggcgcaaatcagcgacaattcattcgcaaaggcgatattcacatcacggaagctattttccgtcagcttgcacatctctgcggtgcgcgagttggtgacaacgcattcgccctcaaggaaaattttgtacagcgcgctggcgcgagccgaacatactggcgtcataccgccaatcacgcggtcatttttaatgagttccaccatcacctgacccggcagcacacgctccggacaataggcgatattcacgtcggcctgctcgcccgcctgctggggaaaggtcagatccgggcgcatcccggccagccagccagccatttgctccgttgcgccgaccggcgatgttgattccagaatcaccagtgcccctttttttaataccggcgcaatggatttcgccgcggcttccacataggccatgtcagggtcgtgatcgcctttgaatggcgtcggcacggcaatcaggtacgcatcggcctcgacaggtgtcgtcgtcgcacgcagaaagccgccttccaccgccatcttcaccacattgcccaacgccggctccacgatgtgaatttcaccgcgatttatggtgtctacagcatgttggttgatatccacgccgataacctgcttctggcgggaagcaaaagcggccgcagtcggtaatccgatataccccagcccaataacagaaatggtcgtaaaactcataacgatacccgataactttttaacgcctgtaaaatgcgcgcgcatgattgcccgtcaccataaggattatgggcgcggctcatggtttgatattcattttcgtcgtgcagcagacgcataacttccgccacaatgcgccgggagtccgtgccgatcagtcttaccgtaccagcggtaatggcttccggacgctctgtggtttcacgcatgaccaataccggcttacctaatgacggcgcttcttcctgaataccgccggaatcggtcagaatgagccaggcgtgattcatcagccagacaaaaggtaagtagtcctgcggctcaatcagtaccacgttttcaacatggccgaggatacggttgacaggttcgctgacgttgggattgagatgcaccggatagacaatttgcacattctggttcgcggcggcaatttccgccagcgcctggcagatatgctcaaagccctgaccaaagctttcacgccgatgaccggtcaccaaaatcatcttcttattcgcgttgaggaaaggatactgctcggccagttcagcctgtaatgtatcgctcgtcagaacgcgatcgcgtacccagatcagcgcgtcaataacggtattgccagtgacaaaaatgcgctcatccggaatgttctcccgcaacagattctgccgcgagttttccgtcggcgcaaagtggtacatcgccagatgtccggtcagcgtgcggtttgcctcttccggccagggggaatagagatcgccggttcgcaacccggcttctacgtgccctaccggaattcgttgatagaaagccgccaggctggtagcaatcgtagtggtggtatctccatgaaccagcaccacatcaggtttaaaatctgccaggatcggctttaatctctccagaattcggcaggtaatttccgtcaacccctgtcccggctgcataatgttgagatcgtaatcaggcacaatagaaaaaagagttaatacctgatcaagcatctcccgatgctgcgcagtaacgcatactttggcctcgaaatgaggatctttttccagcgcatggaccagaggcgccatcttaatggcctccggtcgtgtaccaaatacagtcagtactttcacatcgattctcttcgaatagacagtaggggcccagccccctactgcagaggtgttgctaaatcgtgcggcgacgggttaaggcaacgcccgcaccgattagcgccccaacgataccccacataatcatcaggaaggctcggcgtgggctatcacgttttaccggttcttccggcgtacgcaaataacgataggtctgaaaacgagggtccagggtcggccccacattaagcgtattcaacattgcccgattttgaaagtagtccaaatcgaacgcagggccaaccgcttgcagattttcaagacgcgcctgcaacatagggcgaccgagtaaaaaaagctctgagtccggtaattcatccgccgggacatctgtcgcgctacgagaaatattatgttgttccgcaattttgagcgcctgctcaatactgtttacacgacgcgaatagatcgctttcgcaacctcttcctgccgtttgacctgggctttcatctgcacggtacgcgcagcccaggcaccttttaattcatcattcagatggctcgccgcccgctggctggcgaatgcgacatactgacgcagcagattattggcatccggcgcagtttcagcaatcagcctcacgttgtcgttgatggcgcgtgtaaaatcgccgggcgtaaactgtatgttattgatcagttcatcaagcatcaccgcatcagctttgctattcccgaccattcgctgcttgtaatagtccgtctgtaaccagaaatcgcgacgcgtatcccaggaggcaagttgcatgatgaactctttatacgcttcatccatcaccgagggcttatcagaagaagcaggatcggtcttaatatccaggttgcgcagaaactgctgctgggagtaataaccgcccaacatatttacggttgggcgatcggtgatcgccgtcgcactccactcctgacgagcaaaaaaggtataggctaacgcgataagggcaaatagcaggccaatgccgataatccagaatttgccagcccataaagtacgaaacaacccgcgaatatccagttcattttcagcgctcaccgcgcgtgcccccggtaatggttgtgtcatcgtatcctcatttacttggttaagtttggccggttcttacgttgcctgcgcaggcgacgcttcacacgcttaataaatctcgccaccttccaggcccgcttaatgcagtagccatagaggaagaatgctagcaaaaagagcaccaacataacccattcaggaacaaaatgagagtattctgccgttacgcctactcccgtcagaatcgccgctgcgagcgtaataagaacaaatgcctggcgggaagtaaaccctgctcgcataaccaaatgatgaatatgttggcgatcaggggaaaaggggctcatccctttacgcagacggcgatacataatcgccaccatatccatcaatggaatagcgataatccatagcgcggtaaccgggctgatagagtgagttttcccctgcgtcgtttccagtaagagccagatgacggtaaagccaatcagtgtactaccggcatcacccataaagactttataacgccgccccaaaataccgagattaagcataatgtaaggcagaatcgcggcgatcatggcaaagcaccacattgccagactagtctgaccatcaaaccataaaatcagccccatcgccgcaaatgagacgctggataacccacccagcagtccgtcaataccgtccaccatattgaaagcgttgatcgccgcccatacggcaaacagagtaaggaaatagccaaaggggccaagcactaactcccaaggcccaaagatgtaaccaaggctacctaagtgaagttttgcgataaccatcattacaaccgcaataacagcctgaaccacagcacgaatttttacactgatatcaaaacggtcatccatcgcaccaacaaaaaccaatacaccagcgcaaataagatatagcgataagtgcggtatgtagtaatccgagaggccaaacataaagcagattcctgcaaacacagaaatcccgccgactaatgggataacgccctgatgtcgtttacgaaagtttggtttatccactaaaccaatttttatggctacttttcgcgcaagaaaaataaaaatggtcgtgaataaaaaaatactgattagctcagataaagcggtgagtaacttcacagtgtatgtgctctcagcatatatcatttccttaaagtataatgcgttacgccagctcctagaagagacctgttagaacattacactttttaccgcaaacaatgtgtattgtgcatggtgttactctgtagcgcatatcccgatgaccagtttatatgacatgacgccaggatgaatcgcaaaacaaaaacgccacgtaaaaacgtggcgttttcaggtaaagaccaggttatgagcgcttcatcatctcgaaaaagtcgtcattagttttggtcatcgccagtttgttaatgaggaattccatcgcgtcaatctcacccatcggatggatgattttacgcaggatccacattttctgcagctcttcctgagtggtgagcagctcttctttacgggtaccggaacggttgtagtcgatagccgggaagacacgtttttcagcgatcttacgcgagagatgcagctccatgttaccggtgcctttaaactcttcgtagataacttcgtccatcttggaaccggtatcgattagcgccgtcgcgatgatagtcaggctaccgccctcttccacgttacgcgccgcgccgaagaagcgcttcggacgatgcagggcgttagcatccacaccaccggtcagtactttaccggaagccggcaccacggtgttgtaggcacgcgccagacgggtgatggagtcgagcaggatgatgacgtctttcttgtgttcaaccagacgtttcgccttctcgataaccatttcggcaacctgaacgtggcgggatgccggttcgtcaaaggtagaggcaaccacttcgcctttcaccagacgctgcatctcggttacttcttccggacgttcgtcaatcagcagcaccatcagcacgcagtctgggtggttatacgcgatgctctgcgcgatgttctgcagcagcatggttttacccgccttcggcggcgcgacaatcagaccgcgctggccgcgaccgatcggcgaagccagatccagaacgcgcgccgttaagtcttcggtagaaccgttaccacgctccatacgcagacgagagtttgcgtgcagcggggttaagttctcaaagaggattttgttacgggcgttttccggtttgtcgtagttaacttcgttaactttcaacagcgcaaaatagcgttcaccttctttcggcgggcgaatcttaccagaaatggtatcaccagtgcggaggttgaaacggcggatttggctgggggaaacgtagatatcatcaggaccggcgaggtaggagctgtctgcagaacggaggaaaccaaatccatcctgcaatatctccagcacaccgtcgccaaagatatcttcgccactctttgcgtgctgcttcaggatggcaaaaataatgtcctgcttgcgcatacgggccaggttttccagccccatactttcgccgagagtgatcagctcagaaaccggcgtattctttaattcggtaagattcataatggtgtgagttcttaaacttggggtaaatctcgaacttaatgttgtgaatggtatggcagggtcatccatgcctgtttacggctatcaactcatgtctgttcgctgtctggtcacaggaaagtacgcagaactgaaacgacaagacggaatgagcgaagagccaggaatctttccacttctcgtgcgagaaaaaacgggaagtgacggataaaaccagattcaaacttaataaggtatgtttaattcgaagtcaatactaacttagcacgactcagaccgggcgtccagagatcctgacaatttaagaataacgtaaggacaacagacgccacgaaactgcctgataccttaatcattcgtcgaatgacagacgcctgaccatacagcgcctttgtcattcgacgtataaaaggtattacgccagattggcgtcgagaaactctttcaactgacctttagacaatgcgcctactttggttgccgccacttcgccgtttttaaacagcagcagagtcggaataccgcggatgccatatttaggcgcagtacctgggttctggtcaatgttcagtttggcaacggtcaatttgccctgatattcgtcagcgatttcatccagaatcggagcgatcattttacacggcccgcaccactctgcccagaaatcaacgaggatagccccgtccgctttgagtacatccgtgtcaaaactgtcgtcagtcaggtgaataattttatcgctcatatataactccacaggaataagcctggcgtgttggtgtagcattaaccaacgaggtgctgatgttaacttcgccaacaaaggttgactttatttcaccggatacgctttcgtaaagcaatagtaagctgatattctaccacactatgagcaaaacacatttaacagaacagaagttttccgacttcgccctgcacccacaggtggttgaagcccttgaaaaaaaagggttttataattgtacgcccattcaggcactggcccttccgctaacgctggcgggtcgtgacgttgcagggcaggcgcaaaccggtaccgggaaaacgatggcgtttctgacgtcaacgtttcattatttactttctcatcccgcgatcgacgatcgcaaggtgaaccagccgcgcgcgctgatcatggcgccgacgcgtgaattagccgtacaaattcacgcagacgcggagccgctggcgcaagcgacaggcttaaaattaggcctggcttacggcggcgatggttacgacaagcagcttaaagtgctggaaagcggcgttgatattcttattggtacgacgggccgattgatcgactacgccaaacaaaaccacattaacctcggcgccattcaggtcgtcgtactcgatgaagccgatcgcatgtacgatttgggctttattaaagatatccgctggctgttccgtcgtatgccgccggctgcgcagcgtctgaacatgttgttctccgccaccctgtcttatcgggttcgcgagctggcgtttgaacagatgaacaacgccgaatatgttgaagtggaaccggagcaaaagaccggccaccgcattaaagaagagcttttctacccctctaatgaagagaaaatgcgtttactgcaaacgctgatcgaagaagagtggccggatcgcgccattattttcgccaacaccaagcatcgttgcgaagatatctggggacatctggcggcagatggccatcgtgttggtctgctgaccggcgacgtcgcgcagaaaaagcgcctgcggattctggatgagttcacccgcggcgatctggatattcttgtggcgaccgatgtcgcggcgcgcgggttgcatatccccgccgtaacgcacgtctttaactacgatctgccagacgattgtgaagactatgttcaccgtatcggtcgtaccggtcgcgctggcgccagcggacattccatcagcctggcttgtgaagagtatgcgctgaatctgcccgctattgagagctatatcggccactcgattccggtcagcaaatacaatccggaagcgctcatgaacgatctgcccaagccgttgcgtctgacgcgttcgcgtcctggcaatggtccgcgccgcgctggcgctccgcgtaatcgtcgtcgttcaggttaagaaaagttatgccatacacaaaatcatttagcctgtatcaaggcggcaagaaaacaaatcccgatgagcttaggaagagtacgcagccaacacggatacaggttgaaggatgaagtgtatgaattccacctcgttgtatgccgccattgatctcggttccaatagttttcatatgctggtcgtgcgcgaggcggcgggaagcatccagacgctgacccgaataaaacgcaaggtgcgtctggccgcgggtctgaacaacgacaaccacctttcagccgaagcgatggaacgcggctggcaatgcctgcgtctgtttgctgaacgtttgcaggatatcccgcagccacaaatccgcgtggttgccaccgcaacattgcgtctcgccgtcaatgcaggtgaatttatcgcgaaagcgcagactatccttggttgtccggtgcaggttatcagcggcgaagaagaggcgcggctaatttatcagggggtcgctcataccaccggcggcgcagatcagcgactggtggtggatatcggcggcgccagcactgaactggttaccggcactggcgcgcaaaccacgtcgctgtttagcctgtcgatgggctgcgtaacgtggcttgaacgctattttagcgatcgtaatctggcgcaagaaaactttgatgatgcggagaaagccgcgcgcgatgtactgcgtccggtcgccgatgaactgcgttttcatggctggaaggtctgcgtgggtgcctccggcaccgtacaggcattgcaggaaatcatgatggcgcaggggatggacgagcgcattacgctcgccaaactgcagcagctaaaacaacgcgcgatacagtgcgggcgtctggaagagctggaaatcgaaggcctgacgctggagcgcgcgctggttttcccaagcgggctggctattctaatcgcgatatttaccgagctgaacatccagagcatgacgctggcaggcggcgcgttacgcgaagggctggtgtatgggatgttgcatctggcggtagatcaggatatccgcagccgcacgctgcgaaacattcagcgtcggtttatcgtcgataccgatcaggcaaatcgtgtggcgaagctggcagataacttcctcaaacaggtagaaaatgcctggcatattgaacctatcagtcgtgaactgttgcttagcgcttgccagttgcatgagatcggtctgagcgttgattttaaacaggcgccctatcatgccgcctatttagtacgccatttggatctgcctggctatacgcccgcgcagaaaaagttgctcgccaccctcttactgaatcagaccaatccggtcgatctctcttcgcttcatcagcaaaacgcggtaccgccccgtgttgcggaacagctatgccgtttgctgcgactggcgattctttttgccggtcgccgtcgtgacgatctggtaccagaaattacgctacaggcgctaaatgaaaatctgacgttaaccttgcctggcgactggctggcgcatcacccgctgggtaaagagttgattgatcaggaaagccagtggcaaagctatgtacactggccgctggacgttcgctaaccgtagtctgattgccggatgacgctgcgcttatccggcctacgatttcgctcgctttgccgccatcatggctttcagattagccaggtgactttgccctttttgcattcgctcctcagcgcttaccactttgcgctcctgctcccagattaaatcatcctgcggcagttctaacaggaagcgactgggttccgggcgcaccagtttcccatactgacggcgctctttacataatgtaaaggtgagctctttctgcgcacgagtgatcccgacataggccagccgacgctcttcctcaatattgtcttcgtcaatgctgctttgatgcggcaaaaatccttcttccattcccaccatatagacatacaggaattccagtcctttcgacgcatgaagcgtcatcaactgtacctgatccagctcttcttcgctctcgccgcgctccatcatatcgcgcagcgtaaagcgtgtaaccacctgggtgagcgtcatcggctcatcgagttcgttgccttccagcatctcagtcatccagctaaagagctggttaacgtttttcatacgcatttccgccgctttggggctcggcgaggtttcgtacaaccaggattcatagtcaataccgtggatgagatcgcgcacggcggcgacaggctcacgttcggccagacgctggatttcccccagccagtgggtaaaacgcgtcaatgaatcgtaaccacgtccggtcagcttctggctaagccccatatcaaagctggcggtaaacaggcttttattacgcgtcattgcccattcacccagcttttgcagagtggccggaccgatttcgcgttttggcgtattcacgatgcgcaggaaagcgctgtcatcatccgggttggtcaacacccgcagataggccagcaagtctttaatctccggacgggagaaaaatgaggtgccgccggaaattttgtacggaatgcggttctgcatgaggaatttttcaaatacccgcgactgatgattcccgcgatacagaatggcgtaatccttgtactgggtcttgttcacaaagtgatgggcaatcagttcgccggtaacgcgctcagcttcatgctcttcattgtttgcgcttaacactttgagttccgcgccgtaaccgagttcggaaaagaggcgcttttcaaagacgtgcggattgttggcgatgagaatatttgccgctttcaggatgcggcccgaagaacgatagttttgctccagcttaatcacctgcagcgccggaaaatcctggctcagtaacaccaggttttgcggacgcgccccgcgccaggagtagatagactgatcgtcatcgcctacgaccgtaaagcgcgcgcgttgcccaaccagcagcttaaccaactcatactggctggtgttagtatcctgatattcatccaccagcagataacgaattttattctgccagcgctcgcgcacctcgtcattgcgttgcagcagcagcgtcggcagcaaaatcaaatcatcaaaatcgagaacgttacatgccttcatatgggcgtcgtaaagcccgtagcagtgggcaaaaatacgatcgcgttcacctttcgcccccgccgctgcctgtgcaggcgttttgagatcgtttttccagttggagatcgtggagatcagctgttgcaacagaaccttgtcgtcttcgatcaggccttcggtcagctctttgagcaaggcgacctggtcggtatcgtcaaacaatgaaaagttcgatttcatccccagcgcagcgtactcgcgcttaataatatccagccctagcgtatgaaaggtggagatcatcaaaccgcgcgcttccttacggccgagcgtctgcccgacacgttctttcatctcacgcgctgccttgttggtaaacgtcaccgccgcaatatgccgggcctgatagccgcatccgcggatcaggtgggcgattttattggtaattacgcgagttttaccagaacccgctcctgccagcaccaggcagggtccggtgacgaattcgacagcgtgttgttggccaggatttaaacgcatgggaatagtgctcaatcttcgaacgggggagggattgtagcagaaagcgaggcccagagaagaccaggctgctttttcaggcagcctggaaaaggtcaatcagcaggctctggcggcaagcgacgtatagccattacgctgtgcgctcttgatccaactgtaagaacccattagcgcgatcaccgtcagcagaacatactcaagcgacatcgcataaacgccctgtactgcatagatcacgacgctaattacatcaataatcacccacagcagccagttttccacgtacttgcgggtcatcagcaccatcgccgcaatcgacaacaccagcatggtggaatcccagaacgggaacgcgtccggctggagttcaggcatcgccacctgcatacctaccgtttgcagcagagcgagcataacgcgggtcaacatagcgaagaccggatcgataaaccacgtcatcagcagaatgctaataatacatatgccccccaacctccatgtttgttgacaagaaagccagcgtactttcagagcggcttcccgggcgtcattctgccggctccatgcgtaccagccgtaaatattcgccgcaaagaaaaacacctgaagtagcaagctggcatacagttgaatctgaaaaaagatggcggcaaacagagtgacgttaatcaagccaaacaggtaattaatgattttttcccggctggcgcaccagatgcacaataagccaaagacggtaccgatagcctcaatccacgatagcgcatacccaccctcgccgagaggaatgttgaccattacattgttaatgctgaaaaagtccatcattgctctccttgcaaactatcgaaataaatggcctgaagcgccagagaaatctggcgctcttcaccttgctggcacaaggtttcctgctgaacataatggttaatgctgctctccagacagccactatgcgcgacgaccacgtttagcaacgacgcggtacgcagcccacgtaacgctcccaccaccatcagcgcggcggtttccatatccgcgccgagaactcccctggccgaccattcggcatccagttcagcttcgcgatcggtataaaaactgtcatggctgcgcaccagcccgcaaacggcagagatgttcatctgtttcgcctgctgtatcagcgtggcggtaagataagggtccgcacaggccggataactggcgggcgcataggttttgctggcgccgtcgtcagccaccgcgccgtgggcgatgatcacatcgcccaacgccagcgagtcctgcaacgcgccgcaactaccgatacggattagcgtgttgacgccaacctggcgtaactcctcaatggcgatagcggttgacggtccgccgattcccgtggagagcacgactatttcaaccccctggtaccagccgcgcgccgcgcgaaactcccggttttgcctcagaatctcagccttatcaagaaaacgggcgattctatccacccgcccgggatcgccgggcaaaagcgcatatttcgcgcgggtcatgcttgtgttaagccgaatatggggttgcatctccctctccttattgttctgagaggttcagatttccgcctcctgtttgagtttttcaggagccagtaaaatgatccgctcaccgtcggtatcgataatgttcagcgatttcagatcgtgcagtatccggttgatactgcgcgtcgtcgccgcaaattcctgaccaagattctgcttatcaagcaaaatagtggttgattcatattgttgataacgcagccataatgcctggcatacgcgctgatgcagcgagtacaaattgtcgctactggcctttttcgacaactggtaatactgttggctgaaaaaccgcagcattcgctggttaaagtggttatccagcgtcagccagcggcaaaaatgtgcttgcggcaggctaagtagctgtacattgccgacggctacgacagaacagatgtaatgccgcgactcaaatatctctagctcgcccagcatgtctcctttgccataacgcgcctgccggtaacggcgtccatcttcagcttcgtaaaaaacatccacttcgccggccacgatgagcgaaaattgctagcatgtttccccctggcggcagataagcgcgccgcgggaaatgtcgtcaaatcgccagcactgcatgatttccaacgggcagtatttgagtaattcatagagcactgggtcgcgtacgacctggcgtagccctaaaagccagtcgtctggaaattctgcgtttttcattatgttcatggtatctcgccccttgtcagaaaggacaggaccgtcgtcccgcccatccgaaatacgcccgctaaaaatgccgcttatctcccggttcattaaatcaggcgggacatctgtcctgtaatggcgaagagtatatgtctgacggcctaaggagtgataaagtgacggccaatctttgcgacgtgagaacacaataatggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccactgcatacccagttcggttaccacatcattaaggtattgtatcgtaaataaaaagccgggtggcggctacgccttacccgacctacatcgtctgcttgattttgtcggtcgggtaagcgctagcgccacccgacaaggtatatcaacccgctaccgcaatacgcttcatatccgtcatatagccgcgcagtttcttacctacctgctcaatcgcatgactacgaatcgcgtcgttcacgtcgcgaagctgtgcgttgtttaccgcgcctttcgggatagcactacccagatcgcccggttgcaattccgccataaacggtttcagtagcggtacgcaagcgtaagagaacaggtagttaccgtattctgcggtatcggagataaccacgttcatttcgtacaggcgcttacgggcgatggtgttggcaatcagcggcaactcgtgcagtgattcgtagtaagcggattcttcgatgatgccggaatcgaccatggtttcgaacgctagctcaacgcccgctttcaccatcgcgatcatcagaacgcctttatcgaagtactcctgctcgccgattttaccttcaaactgcggcgcggtttcgaacgcggttttaccggtctcttcacgccaggtcagcagtttcttatcgtcgttcgcccagtcagccatcatgccggaagagaattcgccggagatgatgtcatccatgtgtttctggaacagcggcgccataatctctttcagctgttcggacagcgcgtaagcacgcagtttcgccgggttagacagacggtccatcatcagggtgatgccgccctgcttcagcgcttcggtgatggtttcccagccgaactgaatcagtttttcggcgtatgccgggtcggtgccttctgccaccagcttgtcgaagcacagcagagaaccggcctgcagcataccgcacagaatggtctgctcgcccatcaggtcagatttcacttccgccacgaaagaagattccagtacgcccgcacggtgaccgccggtggccgcagcccaggctttagcaatcgccataccttcgcctttcggatcgttttccgggtgaacggcgatcagcgttggcacaccgaagccacgcttgtattcttcacgtacttcggtgcccggacacttcggtgccaccatcaccacggtgatgtctttacggatctgctcgcccacttcgacgatgttgaagccgtgggagtaacccagcgctgcgccgtctttcatcagcggctgtacagaacgtacaacgtcggagtgctgtttgtccggcgtaaggttaaccaccaggtcagcctgcgggatcagctcttcgtaggtgcctactttgaagccgttttcggtcgctttacgccaggaggcgcgcttctcagcaatagcttctttacgcagggcgtaggaaatatccagaccggagtcacgcatgttcaggccctggttcagaccctgagcgccacagccgacgatgaccacttttttaccctgcaggtagctcgcgccgtcggcgaattcgtcgcggcccataaagcgacatttacccagctgcgccagctgctggcgcagattcagtgtattaaagtagttagccatgatggtgtactccgtgatgttgtgttgtcgcgcttattgttcggtttacagattgctatctgtgcgaatgaacccacattacaacaggaaatttattgcggaaattgatatattcacaacgttatgttgcggtttatgcaacgtcaaaaaccggaggtctgtctgtggatttacgcgatctaaaaaccttcctgcatctggcggaaagccgccattttggccgcagcgcgcgggcgatgcatgtcagtccttccaccctttcccgacagattcagcggctggaagaagacctcggccagccgctgtttgtgcgcgataaccgtacggtcacgctgaccgaagcgggtgaagagctgcgagtgtttgcccaacagacgcttttgcaatatcagcagttgcgccataccctcgatcagcaggggccgtccctttccggcgaactccatatcttctgttcagtgactgcggcgtacagccacctgccgccgattctcgaccgttttcgcgccgaacacccttctgttgaaatcaaattgacgaccggagacgccgccgatgcgatggaaaaggtggtaacgggagaagcggacctggcaatcgccggcaaaccagaaacgctgcccggcgcggtggcgttttcgatgctggaaaatctggcggtggtgctgatcgccccggcgctgccctgcccggtgcgtaatcaggtgtcggttgataagcccgactggtcaacggtgccgtttatcatggccgatcagggaccggtacgccgccgcattgagctgtggtttcgccgccataaaatcagcaatccgcagatttacgccaccgtcggcggtcacgaagcgatggtctcaatggtggcgctgggctgcggcgtggcgctgctgccggaagtggtgctggaaaacagtccggagccggtgcgcaaccgggtgatgattttagaacgcagtgatgaaaaaacgccgtttgagcttggcgtctgcgcgcaaaaaaagcggctgcatgagccgctaattgatgcgttctggaagattttaccgaattagttttacggccctaccattacccgaacaggcttcccaatacggctaagcatattcaccagagcatcaatggtgaatttgctgcatttcttgttgacgacatccgaaacgcgcggtcgggatatatgcaaaactgtagcaacctcggcttgcttcatctggttttgcgtaatccagagggtaatttcttccattagctgttgtttaatggctaacgtgttttcgatttcattcagggaatcagcgtaaaacttttctgcgtcctgcttatgaaaccccaaatcagcaaaaacattaccgccagatggcgtcacatggcgaaaatcactatcagttttggcaatcacaagctgtttctccgttgttgcaccacccggttataacgcgttctggcgatgtttttatcatgctgactggtttgttgcgtctgtttttggaaactatgcaaaacgtagagtgcttctgcaaaattagcgacatacataacgcgatagataccattgttgttacgaatacgaatttcatttaccccagccccaatttctgaaaacggtttccagtcatcgggttcaattccatactgaattttgtgaagctgataaccgactgctttacgtaccgttatgggaaaagccaggagatcctccagagaagatcccacccatcgaatttctttttcattggagagagctcgggtgagtaacataacatctttgtgtataaaattttatacattgtttttagcaggtgcaagtgatggcggtgctaatgatatggagccgagtttcaccacaagcagattgggcgccttctggaaaacgtctcgcaaaatgaaatgagtggatgctccgggctggcaggaaagcccaataactgagggaagataatatctggatattaggcccactttactttgtgggcccgaaaaactaaacgctgaattaacccgccagaaagaaccggaacgccgggttattgctctcatcatggcattcatagcccagttcatgcagccgggtttcgaaatccggctcatgatcgcctaactcgaacgccgccagcacgcggccataatcggtaccgtggctgcggtaatggaatagcgaaatattccagtgcgtgccaagcgtatgaaggaatttgagcaacgcgccgggcgactccggaaattcgaaactatacaaacgctcctgtaatggcttggaggggcgcccgccgaccatatagcgcacatgcagcttcgccatttcatcgtcggagagatccactacgctataaccgccgtcgcacagttgggtgataatctcttttcgttcctccagcccctgactgacgcgtacgccgacaaaaatacaggcatgtttcgcgtcggcaaaacggtagttaaattcggtgaccatacgcccgccaagcaactggcagaatttgaggaagctccccttttcttccggaatggtcaccgccagtaacgcttcgcgctgttcccccagctcgcagcgttcagacacatagcgcaagccgtggaagttgacgttggcgccggaaaggacgtgcgccaggcgttcgccgcgaatattgtgctgggcgatatattttttcatccccgccagcgccagcgcgccggacggctccgccaccgcacgcacatcttcaaacaggtctttcatcgccgcgcagatcgcgtcgctatcgactgtaataatgtcgtcgagatattcctggcacaggcggaaggtttcgtcgccgatgcgttttaccgccacgccttcagcaaataacccaacgcgcgggagatccactggatgaccggcttccaacgccgctttcaggcaggcggaatcctccgcttcgacggcaatcactttgatttgcggcatcaattgtttgatcagtaccgctacgcccgccgccaggccgccgccgccaaccggcacaaagacacgatcgagatgcgaatcctgctgaagcagttccagcgccagcgtgccctgcccggcgatcaccattgggtgatcaaacggcggcacccaggtaaaaccctgctgctgcgccagctcaatagctttcgctttcgcttcatcaaaattagcgccgtgcaacagcacttcgccgccaaaaccgcgtaccgcatcgactttaatatccgccgttgcttttggcatgacgatcagagacttcacgccaagccgcgcggaggagaacgccacgccctgtgcatggttccccgccgacgcggtaatcacgccgtgggctttttgttcttcggtcaatccggccatcatcgcgtaagcgccgcgcagcttaaagctatgtaccggctgccggtcttcgcgtttgacgagaataacgttgtccagacgtgacgagagcttttccattttttgcagcggcgtcacctgcgccgcttcgtatactggcgcgcgtagcaccgcgcgcagatactccgccccttccggcgcgactgacagaggttgagattccgccatcatcaacctcccagtttcgatttatcgcgcaccgcgcctttatcggcgctggtcgccaggctggcgtaggcacgcagggcaaacgaaacctgacgctgacgatttttcggcgtccaggctttatcgccgcgagcttcctgcgcctcgcggcgtgcggcgatttcagcctcgctcaactgcaactgaatgctgcggttcgggatatcaatcgcaatggtgtcgccatcttcaatcagcgcaatagtgtcgccgctggccgcttccggcgagacgtggccgatggaaagacccgaagtaccgccggagaaacgcccatcggtgatgagcgtgcaggctttgcccagccccatcgacttcaggaaactggtcggatagagcatttcctgcattcccggcccgcctttcggcccttcgtagcggattacgaccacatcgccttccactactttgccgccgagaatcgcctctaccgcatcgtcctggctttcgtaaactttgacaggaccggtaaatttaaggatgctgtcatccacgcccgcggtttttacgatgcagccgttttcggcgaagttgccatacagcaccgccagaccgccgtctttgctataggcatattccagcgagcggatgcaacccgctgcgcggtcgtcatccagcgaatcccagcgacaatcctgagagaacgcctgggtagtacggataccggcagggccagcacggaacatttttttaaccgcttcgtcctgcgtaaccgtgatgtcgtactgttccagcgtttgcggcagcgtcaggcctaatacgtttttcacgttgcggttcagcagcccggcgcgatccagctcgcctaaaatacccagcacaccgccggcacggtgaacatcttccatatggtatttctgggtacttggcgccactttacacagctgcggcaccttgcgggacagcttgtcgatatcactcatggtgaagtcgatttccgcttcctgcgccgccgccagtagatgcagaacggtattggtcgaaccgcccatcgcaatatccagcgtcatcgcattctcaaacgccgccttgttggcgatgttacgcggcagtgcgctttcgtcatcctgctcgtaatagcgtttagtcagttcaacaatccgcttaccagcattgaggaacaactgcttccggtcagcatgggtcgccagcagcgagccgttgcccggctgcgacaggcccagcgcttcgatcaggcaattcatggagttagcggtaaacatgccggagcaggagccgcaggttggacaggcggagcgttcaacctggttactttgatcgtcagagactttcgggtccgctccctgaatcatggcatcaaccagatcgagcttgatgatctgatcggacagtttggttttcccggcttccatcgggccgccggagacaaagatcaccggaatattcaggcgcagcgaggccatgagcatccctggggtgattttgtcgcagttggagatacacaccatcgcgtcagcgcagtgagcgttcaccatgtactccacggagtcggcgatcagctcgcgcgacggcagtgaatagagcatacccccgtgccccatggcgatcccgtcatccacggcaatagtgttgaactctttcgccacaccgccggaagcttcaatctgttcggcgaccagcttaccgagatcgcgcagatgaacgtgacccggcacaaactgagtgaatgagttcaccacggtgataatcggtttgccaaaatcactgtcggtcattccggtggcgcgccacagcgcgcgggcacccgccatattacgaccatgagtggtggtggcggaacggtacttaggcatgctttatttactccccattttttcccttcatacttcacgccacaggtgcgttggctgcctcactccagtcacttactacagtaagctcctggggattcgctgcgttgccgccttcctgtgacgcaaattattttgggaaaatattaattttatttattatgaatttaccggatccaaccagccccatttatcctcggtttctccagtgaagagaccaaagaaggcttgttggatacgcttggtaacagggccgcaacggccttcgcctacctggataccatcaacgctgcgtaccggagtaatttctgccgcagttccggacataaacacttcgtcggccagatacagcgattcacgggacagcacctgctcacgcacttcaatacccagctctttcgccagtttgatgatcgcgtcgcgagtaatgcctggcagcgcggaagaggtaaacggcggagtaaacagcacgccatcttttacctcaaacaggttttcgcctgcgccttcggatatatagccgtttacatccagggcgatgccttcctgatagccgtggcggcgcgcttcgctacccaccagcagtgaggaaagatagttcccgcccgctttggcggcggtcggaatggtgttcggcgcagcgcggttccaggaagaaaccatcgcatcgatcccctgatccagcgcttcggcgcccaggtatgccccccacgggaacgcggcgatgatgacgtcagtggtgtatcccgggggcgggttaacgcccataccgacatcgcctacaaataccaacggacggatataggcgctggtcagattatttttacgaattacgtcgcggcaggcttccatcagctcatcaatgctctgggaaaccggaaaacgataaatttttgctgagtcgcgcaggcgctgcatatgttcacgatgacgaaacactaccgggcctttgtgagagtcgtagcaccgaatcccttcaaataccgacgtaccgtagtgcagcgcgtgagacattacgtgaaccttcgcgtcttcccagcgcaccatctcgccattgaaccaaatgtaatcagcttttttcgtcgtcatttttcttccttttgcgctcaggcgcggatttgttgtgatgtggcagcgctctggcagattgcgacatgcgcaacatctaccagtttacttaactgactaaacagtaagtcgaccgaccggggactggcaacggtcaattcaatatttatattctgcgcatcggtcgcggcttccatattcatggagcacacctgaaaaccacgatggcgcaccacgcgtaaaacacgttctaaggtttctggattaaagcgtgccgatacattgacctgatgttgcatcatgataatttctccagcatttcagagttactggcgccaggcggcaccaacggccagacattttcaagttcgtcgattgagacgtgaagcaggtacggcccttcgcttgccaacatcgtgtcgagtgccgcttcaacctggtctttacgagtaatgtgctggcctggaatgccgaaggcgctggccagcatgaggaaatcggggttatcggtcagggtggtttcgctatatcgctcctggaaaaacagttgctgccattgtcgaaccatccctaaccgctggttgtcgagtaagactatcttcaacggtaactgcttgcgttttacggtgcccaactcctgaacattcatcatgaaggagccgtcaccggagatacagataacggtatcattcggtcgcgctacctgcgcgccaacggccgccggtaagccgaatcccatcgtccccagaccgctggaagtgatgaagttctccgggcgggtgtaagtcatatgctgggctgaccacatctgatgctgccccacatccgtcgtcaccacactgtctgcgggtttgcgttccgacaattgcttcaacaacaacggcgcatagatagtctcgccaggatggtcatagcgccaggcgtgttctgcgcgcagctctgcacaagactgacgccatgcgtcgatcttcagcggttgctgtaatgccggcaacagcgaatttaaatcgccctgcaacgcgacgtgtgcctgacgcagtttgttcatttccgccgggtcgatatccatatggattacgctggcgttaggcgcaaacgtattcagcttaccggtcacccggtcatcaaaacgtgcacccactgcgatcagtaaatcacactcttgcaccgcgaaattagccgctttagtaccgtgcattcccagcatgcccagatagtacggataatcagcttcaacagcccccagacctttcagcgtgcaggtaactggcatttgcgttaccgcgataaatttacgcagcgccggaaccgccttcgccataccaacaccaccgccgacgtacagcatgggttttttcgcctgttccagcatctggcgcgcctgttccacatcagcctgcgggaaagtcgcttcgttatcgacggtagtaaaccagggttctagctcaccgctggccaactggatatctttcgggatatccaccagaactggtccgggacggccagcgttggcgacttcaaaagcctccgccatgatgcgcggcaactctgccagcgactgcaccaggaagctgtgtttggtacaggccagcgacagccctaacacatccacctcctggaacgcatcggtgccgatgaacggggcggaaacctgacccgtgatcgcgacaacggggaccgaatctaacaacgcatccgccaggccagtgatcaggttagtggcgccagggcccgaggtggcgatacaaacaccggttttgccggtagaacgggcataaccgattgccgtcattgcggcaccctgctcgtgtcggcacaacaaatgctccacaccaccgtcatacaacgcgtcgtaaaccggcataattgcgccgccaggataaccaaatacggttttcaccccctgcgctcgcaaagcatgtaccacccactgtgccccgttcatagttacatccccgtcgtaaatcttgagaaacagaattttatgctgttattcacgctctgctcctcgcttaagtttttcaggccaaaaaaaacccccggacctttcggtgcgggggtcttagttcgttaaggcttgatttctaagcctttcctcgtccaagtgcagccccgcacggtgggataataatcaccaccacgctaatcacgaccaggctaatcactcgtagaagggctgtcatttttgtctattcttgcatcttgttcgaaggaatacctaaagagttaccataggttttgccaatagcacaagatatttttttaaccacgtttcagataatgcaggtgaatgcctaaaagggctttgttttttataagaaaaattagcaactgaaaaattttcacgttttcctcccccttttggtgcgctttacaccctgttttccttcttttcgcttctgcgagcgttcttccagtttgatgtttcttacctgaaaatgacgccaaaattcaggaatcagccgctaaaaaacaaaaagtcagtaattcgattttctcttctattccgcataatccacgtaacaggagggattatgtcactggcgattgttcatactcgcgccgcacttggcgtcaatgcgccgcctatcactatagaggtgcatatcagtaatggattaccgggattaaccatggttggcctaccggaaaccacggtaaaagaggtgcgtgaccgggtacgtagtgcgattattaatagcggatatgaatttccggctaaaaaaataaccatttatgtaaacgggttaatgaaaacaacaagttagattaaaaacaataagttaggttggtggtcagtggtggttattacggggtaatgccaaccgctgccgccactttgtcgccacttggcagcgttgccagaggattgaaacggagcgccgtttccagatgatccggtgccagatgtgcgtaacgcatagtcatttttatatcgtggtgtccgagaattttttgtaaggccagaatgtttccacccgacatcatgaagtgcgccgcaaacgtatggcgcagaacgtgtgtgagttgaccgcgagggagcacgatagacgttttttccatcacggataaaaattgaaaatagcagtctgtgaagaaattgaacccatcaagcgccatgatctcttcgtaaagctctttactgatagggatgcttctgtttttcttccccttcgttcttacaaaggtaattcggtatttggtcacctgtgaacgagtaagatttacggcttctcgccagcgtgcgcctgtgcttaagcatatcttaactaccagtgctagaattgggtcctgacgtttgcaatcagccagtaattcaacaatctgctcatgggtaagccatgccatctctttttctgcgatggtgaattttcgcatgttctccagtgggttcggatacgaccattcgcccagacgggatagttcgctaaaaacactacttagatagctttgctccaggttaatggtgaccgggcttgctcctttcttccatttctcgctgaagtagatctcgcctgtcaggcgtttatctcgatagtgggcaaacattttagaggtgagatcggttgcaagaggattgcccagagcgtcaaccatcagcagcaatttgtcatagacatgttgcccagcagtcagagatttaccatgtagtttgaaccatagctcaaccacgtctttcagggttcgacgatccactgattcgcccagccatggctttgattcggtttcttccatagtgtgacgctcaaaagccagagcttcgcctttggtggcgaattgtttacgcacacgacgcccacttcgtccggcggggtaacattcgcaaagccatttccctgtggtgagttttcgtactgccataaaaaatgccctccagtagagagcatttttactgtatgtataaccagtgtcaatgtatgaaatcctacgaccatacatctcactgaagccataatgaagttggctattctttttgctatgtgagcatgtaacttttgcggttaacctgcggctcatttttattttagacgcagatataaaagcaaaagttatcgtgagtttttagtacagatttttttggatttactaatagttccatcattgcaaacgaatttgccatctgaggtacagtgagaaacacctccctttttccctgagcagggataatttctagcataggtagttagtgggtttaataacaaagaacatgacaaaaccacaaaaaataccttaccaagcatagtttcctcccggtactatttaacatacttgactgttaaacttataattttaccaattatttcaatgtcttctatcttacattcgaaggctctgtttccaccctcgacgaagattcttccaccgggtaaacgagtaatgtcacggatcgttacttcgccatcaatacttattacccatttaccatcacgtatatcatcaaattctttatcacaaataaattcagaattgttatctgtgatgacaaaaggttttttaaacgtagagggtagaaatcccttatcaaaaatataaaaaccgtcttcacgcaaggcaccatcagataatacatatttagcaacttccatagtatttgtattacctgaagtttgctttgaaccatgtccggttgtgagccaattaagcgaggtgcccgtttcaagggcgcactggattacccattctgctgggaatgagtcacgcatgtagcgtgtggcgagtgtacttttagagattcctaaatgatcgcacaacgcctgtcgagttttgaatccataagcttctaccatgcgctctatagcgcctcgtccgcctttctccaaattcatggtcactccaagtgaacttttatcttgacgatttcattgcgcgatcgtatgtttatggtgttcacaaaatacaaacgatccgtattcgtcctgattaatcatcattaaacgaggaatgttgcatcatgagacctaacatttcaatcactcttaccacgcctcatgtgactattgagcgctatagcgagctgacagggctgtccatcgataccatcaatgacatgttggctgacggacgccttatctgtcaccgtttgcgcaaagataaaaaacgcgaaaaagtgatgatcaacatagcagccatgaccgttgatgcgctttcagaatgcaatctaaaccttaattagttcgattctgaaatacatcagaggcattgaccatgtttgattaccaagtttccaaacatccacattttgatgaagcctgtcgtgcatttgcactgcgccacaatctggtgcaactggcagaacgtgcaggcatgaatgtgcagattctgcggaacaagctgaacccagctcagcctcatctattaaccgcaccagaaatctggctgcttaccgatctgactgaagattcaacgctggtagatggttttctggcacagattcattgtctgccatgtgtaccgattaatgaggtggcaaaagagaaactgccacattacgtcatgagtgcaaccgcagagatcgggcgtgttgctgcaggtgcggtatctggcgatgtaaaaaccagtgcaggtcgtcgtgatgctatcagcagcattaactctgtaacacgactgatggcgttggctgctgtttcattgcaggcccgtttacaggctaaccctgcgatggcgagtgcagttgataccgtgaccggcctcggtgcttcattcggtttgctgtgaggtgcttatgctgacgaaagaaccatcatttgcatcgctgctggtaaagcaaagcccggcaatgcactacggtcacggctggatcatgggtgaggatggaaaacgctggcatccatgtcattcacaagatgaattgctgtctgaattgaccacgaggaaacggagaaagtcaaaatgtatgcagcggaaagtgaagtggtttatcagttttgttacagaggggagagttattcagtacctgaagatgatttgctctgttgttatccgtcgttgtcgggcgatggcagttactttttcacgctaaaggatgggacgtttttacggggagagcaggttaaagagacggtacgaaaaaatgtatctccctttgagcgttaccgtaagaacaaagaacgataggtgcgtttgggggatatgaagtatggcaattaatggcgctgcggcgactgttccattaagccccggagaacgcctgaatggacttaatcacattgcggaattaagggcgaaagtatttggcctgaatattgagtcagagcttgagcggtttattaaagatatgcgtgatccacgggatatcaataacgaacaaaataaacgggcactggctgccatattctttatggcaaaaattccagctgaacgtcatagcatcagcattaatgagctgaccactgacgaaaagcgggagttgattaaagcaatgaatcattttcgtgcagtggtgagcttatttcccagacggctaaccatgccgaattaaccaactaatgaaattaatggcgtaaacccgccgggcatccctttatctaaattcaggagaattgattatgcgtaatattgaaaccctctcgaccaaaaccggaccggatgacgcagggcttaatattttactgacagaggctcgtctggaagaacgccgggcaagggctgaagcaatggtagctcgccttgatagcctggcgtgtcatatcacatcccgccagctaacccacgtcgaagcggcagaactgcttcgtgtgactgctgaagcaatccagaacgaagcgcaggagatccactaatggctgatgcaatggatctcgtacagcagcgcgttgaagaagaacgccaacgccatatccgtgctgcccgtgccaaaacgccgggcgtgtcccgcgtgctttgcattgagtgtgaagcgccaattccgccagcacgccgccgtgccattccgggtgtgcagctttgcattacctgtcaggaaatcgcagagctgaaaggcaaacattacaacggaggtgctgtatgagcaccatcctgaaatgggcgggaaataaaactgtcataatgtccgaactgaaaaaacatcttcctgctggcccgcgactggttgaacctttcgcgggttcctgtgctgtgatgatggagacggattatcccagctatctggttgcggatattaatcctgatttaatcaacctctataaaaaggttgccgctgattgtgaatcgtttatatctcgcgccagagttttatttgagatcgcaaacagggaggtggcttattacaacataaggcaggagtttaattactcaactgaaattactgatttcatgaaagcggtatatttcctgtatctcaatcgtcatggttaccgtgggttatgtcgttataacaagagcgggcatttcaacattccatacggtaattataaaaatccgtatttccctgaaaaagaaattcgcgcatttgcagagaaagcccagcaagcaacgtttatctgcgccagctttgatgaaacgctggcgatgctgcaggtgggggatgtggtgtattgcgatccgccttatgacggtacgtttttcggctatcacactaacggcttcactgaagatgaccagtatcacctggcatctgttcttgaatatcgatcatcagaaggtcatccagtcattgtttctaacagtgacacatccctgatccgttcgctgtatcgaaatttcactcaccactacatcaaggcaaaacgcagcatcggcgtgtcggctggcgagagtaaatctgcaacagaaatcatcgctgtttctggggcgcgctgctgggtgggatttgatccttcgcgtggcgtggatagttctgccgtgtacggagtgcgtgcatgagccatgctgatatgaacaactgcagcggctttaacgaggccgccgcagcattctcatggaacagcccgaaaaaggctattaacccttatctggacctggcggaagttgcgccggtttctgcgctttcaaacctgatcactctgtacgctgccgataacgagcaggaacaactgcgccgcgaggcactgagtgatcaggtttgggagcgttatttctttaatgaatcccgtgatcctgtccagcgcgaaatggagcaggataagttcattagccgggcaaagttggcgcatgagcagcagcgttttaacccggacatggtcattctggcagacgttaacgcccagccttcccatatcagcaggccgctgatgcaacgtattgaatacttcagcagccttggcaggccaaaggcttattcccgctatttacgtgagacgattaagccatgtctggaacggctggagcatgtacgcgacagtcagctatccacttcttttcgctttatggcaagccatgaagggctggacggcctgctgattctgcctgaaatgagtcaggatcaggtgaaacgcctgtccacccttgttgctgcgcatatgagcatgtgccttgatgcagcttgtggcgatttgtatgccaccgatgacgttaagccagaagaaatccgcaagacatgggaaaaggtggcagcagaaaccctgcgactggatgtcataccgcctgcgtttgagcaactccgccggaaaagaaaccgccgtaaacccgtgccctatgaactcattccgggttcgctggcgcgtatgttgtgcgccgattggtggtaccggaaattatggaagatgcgttgcgaatggcgggaagagcagttgcgtgctgtttgcctggtcagcaaaaaagcatctccctatgtcagctatgaagccatgatgcataaacgtgagcagcgccgtaagtcgctggagtttttccgttctcatgaactggtgaacgaagacggcgacacgctggacatggaggatgtggtaaacgccagcagcagcaaccctgcgcatcgccgcaatgagatgatggcctgtgttaaaggtctggagcttatcgcggaaatgcgcggtgactgcgccgttttctacaccatcacctgtccgtcacgtttccattccacgctaaataacggcaggcccaacccgacctggacaaatacgacggtaagacaaagcagtgattatctggtcggcatgtttgctgcatttcgtaaggcgatgcacaaagccggattgcgctggtatggcgtgcgggtggctgagccgcatcatgacggtacagttcactggcacctgttgtgttttatgcgcaaaaaagatcgccgcaccattactgctttgttgcgtaagtttgccattcgtgaagaccgcgaggagctgggtaataacacgggaccacgctttaagtctgagctgataaacccgcgcaaaggtacgccaacaagctacatcgcgaaatacatcagtaagaacattgacgggcgtggtctggctggcgagatcagcaaggaaacgggtaaatccctgcgtgataacgctgaatacgttaatgcctgggcgtctctgcatcgtgttcagcaattccgcttctttggcattccggggcgtcaggcttaccgtgaactgcgattgctggctggtcaggcggcaaggcaacagggggacaaaaaagcaggtgcgccggtactggataacccgcgccttgatgcaatcctggctgctgctgatgctggttgttttgccacctacatcatgaagcagggcggcgtactggttccccgcaaatatcacctcatcagaactgcttatgaaatcaacgaagaaccgaccgcatatggcgatcacggtattcgtatttatggcatctggtcacccattgcagagggcaagatctgcactcatgcggtgaagtggaaaatggttcgtaaggccgttgacgttcaggaggcggcagccgaccagggcgcttgcgccccttggactcgtggcaataactgtccccttgctgaaaatttgaaccaacatgagaaagataaatcagcagatggggataccagaacggacattacctgcatggatgacaaggaattgcacgattacctgcacagtatgggcaaaaaagagcaccgggaactggcagcaagattacgcctggttaaaccgaaacggcgtaaagaccacaaacagcgaattacagagcatcagcgtcagcagctcgtctatgaactgaagtccagaggatttgatggcagcgagaaagaagtcgatttactgcttcgtggcggcagtattccgtcaggagcaggcctgcgtatcttctatcggaaccagcgtttgcaggaagatgataagtggcgggatctgtattaattacgcgggttaacaattcgtgctcttaataataccaggcatatcaggctgatgaacgtaaaaaaacgttttacatcagtaagattattatatactgtaaatataaacagtggttatatgtacagtattgcgtatggtgttataggaggaaagatgcaggactattttttggagtctttgaagctccagcgcattgatttttttcttaagcttgtagcggctagtgagtgtagcgatgaagagaaggggctggctctgcagtgggtttctgaattgactgatgagttgatggcgaaaattcgaagccatgaatacagtaggtcgatggatgtaatcagttgagcttgtttcgttaggacttgataagggaaccgaaaaggggcattaagcccctttctcataagttgatttagttgttccccaaagagccggccatggctgcatatttaatttcttcgctgggtatttcaggatgtagttgaatttgcctgatgacatagccaggaacttcgtcactccacagtttcgccgcgtccttacagaccttatacgcgaagtctctattctcaaaggcataggattttccgtatgcatattgctgacaggtatgaacataagctccgaagtcgccgtctttatctggcaaagcacatccagccaaggctatgatgattgctactaacgtaaaggagaaagttatacgtttcatggtctctttctaagcgtttagcattatttaactaaggggtatctgccgtgatttggtagtccctgatatatattctcagggactatgctgaagtagatttaatttcgattatttagaaaggtacttatctctaagttgattcagtctgtcagcatcgcgttctgaaaactcggcgtcaccatagatcgatttcccatctgcgtcttcaaggccaatgactgtgacggtaaatatagcatcagccggaactttaagttttccccaatcagagtatctattaggggctaatttccagttggctttctcacctggttccagacctccagaaattttatagttgaagacgtcagagaaccaagggacgcttcttcctgggctggcaataacacctttgaagaatactctggcaaccgctttgtctgttccgttttcaacgctaatatccagaattggctgatcattgccgtaatcctctttctggaaataaaaacgggaacgttcgaccttgaaggctttcattttttccgcagcctgtgttgcagaggtttgtttggcttccagttcttttatttcttgcagagcctgttctttctctctcttctcacgctcaaggcgaatagtttgtgcgtaatttataacctcatcaccagttttaccttccaacgctgacttaatttttgtttcgtagacgtccccagaagacgttccagcctgcattagctctctcatgttgatttggctaaaggcaacgactttaactgcatcatcaaactgagcttttttatctgcaggtaaggactctcttactttttgaatggactctttcatcgactgatcgcttgatgcatcgatcttcggtttgtcacaagcagtaagcagcagagcaaaagcaattacgccagttaatttcttcatatccctatcccaatcgtaaaaaaacaaggctaatcctaacaggattagctggcatgacaaactcatagccatataggtgtgctgtataaattagcgggatgagaaagcctgcgcagaccctcatgttgaaacttgattttagctcaaaagagctgacactaaataactgcgcggaataatgctccacttcggttagcccttgctgggtaaggcgtggggccgttttcttcgcctgatcctgctgtatctggcctacagtatgttgcccttacgcgacatgccacatgtcagtaaacggcaggtgtagcagtattagacgcagctatttagtgtgtattaagctggctcatatttatgactggtttcaaagtttgaccgattttcatgtcatgcatgtctatgctgcatgagttcgcatgatcgtttgaggatcggtttggctaagacatgccagaactggcgggcttttgcttatgtcatgcaggtgcatgaaaaccactacataaagcgggcaggcgtggcggggatacgagcgcgcgctaagtcatataagagttatatattgatttgattgctggacatgcatacagtatcgctctatcatctaataaatcttagagtatttgacaatgtttggataaaatggaacctaacttattcataatccgctaaacagggatgtcagatgccataccaattggtagagcttagccccgtagctaacgatcttgaacagttaggaaccaaagagaagttttggttctatttctccgatgacactgtaaatttgcagttgtttaagtactctaggctaggtactggcgagcattggtctgaaaagtgtgctgctgagttatgtcatttgcttaacattccacatgctagctatgatttggcgcgatacaatggtcgattcggtgtggtgactcagaatatcattccatctggtttccggatggtaatgggaaatgaagtgcttcacagttcgacattcgattatcctgggcctttacaagccggggaaaagccggtaagggtcagagaacacactgtcacaagggtattgggttgtttagatagggaatctatcaagcctcctccgagtgtatatgatctaaccgggctaaatgcagcagatgtattttgtggatttttgatgctcgatgcacttgtgagtaatcaagatcgccatcatgaaaattgggcgatcatgcttaacaatgaaactggtgagcagtttttgtgtccaacatacgatcatgccgctagtttaggaagggagatgttagatgatgagcgtaacgaacggcttaatactaaagataaaaatcgacaaatcccatgttttgtaagaaaagctcgctctgagctattcaaagcaaaaactgataaaaagcccttgctgaccgttgaagcatttcaacatgcagttgaagggagagttgccgctcgcgaccattggttaggtaagttgagcgttttaacagaagattccattacagatgtgtttaaccaagtgccttcatcgtgtatatccgacagtgcacgtagatttgcaacgttaatggtaatggaaaatcgcagaaggttactagaatgactaatacaaactccgtttacgtcgcatggcaggcaccagataccagagactggcatgttgttggtaacttgcaagagcgcaaatcggggtatgttttcaggtataccaaaggtgctcttaaatctactaaatttacaaagtttagcggcatgagtgatgttcgtgaaacttatgtttcggaagaattgtttcctctttttaaaaatcgccttttatcaccgagacgtccagagtatccgagtttcattaaatggcttggatttgaagaagataaggtaaatcctatcgatattcttgctcgctcgggaggcttacgaagcactgatcagctgcagattttcaaaaaaattgatgttgattctgatggtaactttgagcattttttcttcttacatggacttggttacttaaatagcttagctaatgctcgtgtatctgaattgaaaccggggcaaattttgcgtctttgcttggatcttcaaaatgaatacgatggggatgctgttgtcgttcgtgcagataaatcagctgaaatcgttggttactgccctaggtatttaagtaatgatatcaagaagatgttattggatgatccaaaatcaatcactttaacggtcgaaaagattagcgatgatgctcctcataactatcggttattatgtaaattatcaggagtactaagccaagcctgtcaatcgacgctgattcctcaggatgagtttgaacctattgagtaaatgaagaaaagccaccaaacggtggcttttcttattatgggactatatctagcgagtaggtattaaactgtatcgcctccttgccaagccaatcattcatctcctgtaatcgcttttgtagtggcattagctcatttcggacgaatacacggcttgccttctccacatccccaaaccccccaacattattcggcataatccccatcatttgcggtggcacacgatgcgccgccatcatgtcgtcccggcttacgttcttgatgttcagaaactcatcctttgccgccacttctgacagcgggatgatctgaagcccgtcctttttgccgttaggcgagtacataaacaggttgcggaagttgcccggacctttggcgcttttcatcgcgttgcggaggttgttcacatcctcctggttctgagcggcatcggtcatgtacattatgaatcctgcatggctgccattaatataatatttgcgtcggaacagcgtggcggactcgttgagcagggctgacggaatggcagaaagatagccgggcaggccgtagatctcctggttgatatcgggttccatcagatgaaagatgctgcctttcgtgaactgatacggctgggttgtcataccgtattgcacaaaccagtaggtatccaggtctaacccgcgtcgggtgtattttgccagagcaggctcaagggcgataatttcaccgaaccggttcgtgcgtttctccaggtaggcgttaccaaataccagatagtcctgcacaaaacgtgaaaaagcctgctggctgagcagcgggtgagggatgtaggtgctggtcagaatgttgcatttcaccgcaatcggtgagctatgatgcacggcggcgcggaaggttcgcgccagtccgtcgaaactcactggtggctcataccagcggtccatctgtacgcattccacatagtccagtaattcgcggcggtccagaacaggaacgggatcgccgaagctgaatgcttcggctgaagtctggcttttatgctggatctgattcatcgccgctgcgcggtttttcttacgctttcccatcaaaaaatctccacaatattgctggtattggcggactcgccttgcagtggttcgttaaacagtgcgtgcatcgttgcccaggccagatcggcgtggctggcttcttcgctgcggctggcttcataggtcgggcggttgccactggcggtggtggcgcgacggattgccataaatgactgcgctatgtcggtgtgtccggcgtcaaactccagacggcggtggctgataatgtcgtaggccttgagtaccagagcgtttttaacgttggggttgtagacaaactcccggacggcaggaaagaacgctttcacgttctcataaaccccgtgaccgacgcctgtcgagtcaatgccgatataggtcacgttgtactgctcggtcagttttttgattgcatcagcctgggcgcggaagtccatcccgcgccactggtgacgctcaagaatgcgaaacttaccgcctggcacggctggcggtgccaccaccacgcatccggcgctgtcgccgttctgcgtacctttcgccgggtcataaccgatccacacctcgcgccagccaaacgggcgcagggccagtgcatgaaagtcggtccagacttcccaactgtccaccatgcacgcctgcagttcgctgagcgggaacacggacgcgagatcgtccacgaactcgcacatcagcaggttctggtattcgtccgggctgtactccatgcgcagctggtcgaggtcgaacaggttacagccgccgcgcaccgcatcttccacggtgactatctggcggtattgcccgtctgcgcacagcaagccgggggccagattgttgtgggacaggtcgatgtccaccttatcggctttgttgcgcccacggttaaacagcgcgccggaccagaacggataagcactgtgtgtaaggctggatggcgtggaaaaataggtttgtcgccattttttgtgaatagccataccggaagccactttgcgcagctcctggaatttcggtatccagaaatattcatccagatacaggttgccgtggtaactctgggccgtgcgggcattggtgccgaggaagtaaagcgtggccccgttgggaagcaccatcggatcgcctttcagctccacctccacttctttggcgaagtcgatgatgtactgtttaaagacgtgggcctgtgccttactggcggaaaggaaaatctggttacgtccggtaagcagggcgtcaatcagggcttcacgggcaaagtaaaaggtcgcgccgatctggcgtgacttcagcaggttgcggatgcggttggtttttccggcttcccaccagtggcgctggtagttgaacatggaggaatggaaaatttcttccagcttctcaatctgttcatcggtgaaaacgttcttttccggctgacggcgtgggcctttgttgcggttggcgacgttagggtttaagtcggcttcgttgccgccattgttaaacttgccgatccgcgcgtggcgttccgactggcgcgccagcaggtcaatctctttgaaatctttcccttctttgtgctccttcataatgagctggcagtagcgtgcggcggtggtgagctgcatctgatccagcggcccatagtcgccccacttgtcgcgttttttccagctgtgaacggttgcaactttttcgcccagcatttcagcaatgcgggctacgcggtatccctgaaagtacagcagcatggcctgccgacggggatcgagatctgcgggtgtcagtgtggtgttcatggcacaaacctacagccttgaatgaaggctttccccgcctgcggtttgtgtggttgtcggtacaaataccgcgcattgtttcactgcccccatcaccgcaaccataaggctccagtaagttttttctaacggagcacggctcatgacagtgaaagcaaagcgttttcgcatcggggtggaaggtgccactaccgacggacgcgaaatccagcgtgaatggctggaacagatggcagccagctacaatccggcggtgtataccgcgctgattaaccttgagcacatcaagtcttatctgccggacagcacctttaaccgctacggcaaggtgacggcgctgtttgctgaagaaatcacggaaggtccgctggcgggcaagatggcactgtatgccgacgttgagccaacggagtccctggtggagctggtgaaaaaaggccagaaattattcacctctatggaagtcagcccgaagttcgctgatacgggcaaagcctacctggtcggcctggctgccactgatgaccctgccagtctgggcactgaaatgctgacattcagcgccagtgcagcccataacccgctggcaaaccgcaagcagaatcccgccaatctctttaccgccgcagaggaaacggtgatcgaactggaagaaatccaggaggacaagctgtccctgtttgcccgcgtcacggcactgttcaccaaaaaagagcagtccgacgatgcccggttctctgatgtgcataaggccgtggagttggtcgccactgagcagcaaaacctgagcgcacgcaccgaaaaatccctgtctgagcaggaagaacgtctgtctgagctggagactgccctgcaggcacagcagacagcctttaacgaactggtgaataagctgagtcatgaagacagccgccaggactaccgccagcgtgcaacaggcggtaacgcccccgctgacactctgaccaattgctgatggagcacaaaacccgatgaagaagaatacccgctttgcttttaacgcttacctgcagcagctggcgcgtctgaacggtgttgcagttgaagaactgtccagcaagttcaccgtcgaaccgtccgtgcagcagacgctggaagaccagatccagcagtccgccgctttcctgacactgattaacgtcacgccagtgactgagcagtccggtcagttgctggggctgggcgttggcagcaccattgccggaaccactgataccaccgcgaaagagcgtgaacctgtcgatccgacgctgatggttgatgtggaatataaatgcgagcagactaactttgacacggtgctgacctacgcgaagctggacctgtgggcgaagtttcaggatttccaggtgcgtatccgtgacgccatcgtgaaacgtcaggcactggaccgcatcatgatcggctttaacggcgtgaagcgtgcgaaaacctccaaccgtagcgaaaacccgctgctgcaggatgtgaataaaggctggctgcagaaaatccgtgaggatgcaccggatcacgtcatgggcagcaccaccacgggcggtgaaactacaccgggtgcggtgaaagtcgggaaaggtggcgaatatgccaacctagacgccgtagtgatggatgccgtcaatgagcttatcgacgtggtttaccaggacgatgacgatctggtggttatttgcgggcgtgaactgctgtctgacaagtatttcccgctggtcaacaaagagcaggaaaacagtgaaaaactggctgccgatatgatcatcagtcagaaacgcatgggtggcctgcaggccgtgcgtgcgccgttcttcccgccgaatgcgctgctaatcacccgtctggataacctgtccatctactggcaggaaggcacccgccgccgttcagttatcgacaacccgaaacgcgaccggattgaaaactttgaatccgttaacgaagcctatgtggttgaggactaccgctgcgccgcactggtggaaaacatccagattggcgatttcagcgccgctgcagcagaagccggagcgtaacctatgagcctgagtcccgcacggcagcatcgcctgcgcgttcaggctgaacaggccgcccgcgagggcggcagcgttcgccacgcatctggctatgacctgatgctgctgcaactggcggaagaccgccgccgtctcaagggcgttcagtccacggtcaaaaaagcggaaataaaggtggagctgctgccgaaatatgccgcctgggcggagggcgtcctggctgccggaggcgctcaacaggatgacgtgctgatgtacgtgatgctgtggcgcattgatgccggagattatgccggggcgctggagatcgggcgtcatgccctgcgtcatggctgggtgatgccgctgggtaaccgcaatgtgcagaccgtgctggcagaggaaatggcagatgcagcgcagagcgcaatgcttgccgccaccggctttgatgccgatctgttgctgcagacgctggagctgacagacggtctggatatgccggaccagtcacgggcgcgtctgcataaagcgattggcgctgttctgagtgaaagcaatccggcttccgcccttaatcatctcaaccatgcgttacagctcgatccccgctgtggcgtgaaaaaagacaaacagcagctggagcgcagactgcgcaatgacagccgctgacagaacgtgcccccgcgcacgggcggcacgggatggcgaaaggcactgccacatcaaaaccccgtccaccgccctttatttcaggagaaagcagcatgaagtttgttgcgccagaacaggcaccggaacaggcggaaatcatcagaaatacgccgttctggcctgatgtggacctgtcggagtttcgcagcatgatgcgcactgatggcacggtgacgcagccgcgtttaaagcaggttgcgctgtcggcaatttcggaggtcaacgcagagctgtatgagtttcgcagacgccagcagatgctggggtatgcctcgctggcagaagtcccggcggaacaactggacggcaaaagcgagcgcattcagcactatttcaacgcggtttactgctgggcacgcgccatgctcaacgaacgttaccaggactatgacgccacggcatccggtgtgaagcggggcgaagaactggcagaagccagcggtgatttgtggcgtgacgcccgctgggccatcagccgggtgcaggatgcgccgcactgcacagtggagcttatctgatgaaagtgcgtgcgcatcagtatgacacggtggacgcgctttgctggcgtcattacgggcgcacgcagggtgtcacggagcaggtactgaaggcaaatccggggcttgccgaatacggcccctttttacctcacgggctgcaggtgaagctgccggacattccgaccaccaccaccgtgcagaccgtccagctatgggactgaattatgacgcttgagcgaatcagcgcctttatcacgtattgcatcgccgtcgtgctggcctggctgggcgatttgtccatcaaggatgcctcaacgctgggcggcctgatgattggtgtgctgatgctggctatcaactggtactacaaacacaaagcctaccagcttctgcgcgacgggcagatctcgcgggaggactatgaatccatcaatcgttaaacgctgccttgtcggggccgtgctggctattgctgccacgctgccgggttttcagcagcttcacacctccgtggaggggctgaaactgattgccgattacgaaggttgtcgtctgcagccgtatcagtgcagcgcgggtgtctggaccgacggcattggtaatacgtcaggcgtcattcccggcaaaaccattacggagcgacaggcagcagaagggctgatctccaacgtgctgcgtgtggagcgggcgctggaaaggtgtgtgaagcaacagccgccgcagaaggtgtatgacgctgcggtgtcgtttgccttcaacgtgggaacgggcaatgcctgcagttccacactggtgaaattactcaatcagcggcgctgggcggatgcgtgccgacagttgccgcgctgggtttatgtgaaaggtgtttttaatcaggggctggataaccgccgtgcgcgggagatggcctggtgcttacagggagcaaactgaaatgaaaaagaaattaatcagcggactgtttctgatgttatggatggcgctgttaatcgcagcaatggtgtatccgcaggggatttttccggtactggcagcgtccggcgtttgggtagcctgtttgctgacatgggcggtaattccggtagcactggctgcgttaattaagaatggcccgctctggcaggagttaagggcatctttgctgaagacaattacccgaaaagaaaacgtatttaccagttgggtgatgcgattgctgattgttgtaagtctcgcctggacggggtgggctattaccctggtcttttatctactgaccgttattgccttctggatcacccgtaatcagatggcgcaacaggtagcagcatgaaccggttgctgctggttgtgctggcgttattactggcggcgctgggctggcagacgtggcggctggctgatgccagccagaccatcagcacgcaggcagacgagctgcagagcaaaagccaggcactggcaaagagcaacagccagcttatcagcctgtccattctgactgaaaccaataaccgggagcaggcgcggctctatgccgaagcagaacagaccagcgcacagctgagacaacgacaacgccggatcgaggaactgaaacgtgagaacgaggatttacgccactgggctgatactcctttgcctgctgacattatccggctgcgggaacgtccggcactcaccggaggtgcagcttaccgtcagtggttgtccgcgagtgacgccgtgtcggctggagcaggcagcaccgcgcactaacggtgatctgaatgcgttgctggatgaaacggaggccgcctgggcggtctgtgcagacaaagtggacatgattattgcgtgtcaggagcgaaacagtgaacaaaccacaatccctgcgccacgccctcaataaagcggtgccttatgtccgcaataacccggacaaactgcatctgtttgtggataacggttcgctggttgccacgggggccagctccatgtcatgggagtaccgctataccctgaacgtggtgatagaggatttcagcggcgaccagaatctgctgatggccccggttttactgtggcttcgggataaccagcccgatgccatcaataacccggcgttacgggaaaagctattcacctttgatgtggatattttgcgcaacgatgtctgtgatatcagccttaatctgcaactgacggaacgtgtgctggtcagcactgacggcagtgtgtcgagcgttgaagctgtagcagaacccgatgaacctgaagaaatgtggacggtgaaacgtggctgaactgcagaaggtggacgactggctgagtgccttgctggcgaatctggaaccagccacgagaagccgcatgatgcgccagctggcgcaggaactgcgccggacacagcagcagaatatcaggatgcagcgcaatccagatggcagcagttatgaaccgcgcagggtaacagcacgcagcaagaaagggcgcatcaaacgtcagatgtttgcaaagctgcgcaccacaaaatacctgaaaactgccgccagcgccgactctgccagtgtacagtttgaaggcaaggtgcagcgtattgcccgtgttcaccattacggcctgcgtgatcgcgtcagtcgcaaaggaccggaggtccgttacgcagagcgtcgcctgctgggtgtaaatgatgatgttgaggcaatgacccgcgacatgattctgcaatggctggcggggtgatctttgtatcagcactgatacaagttgcagcattgccgcctttcttcccctgatggcaacctttccctatgaacgcacaattaaccgaaatcatgcgccttatcaccaatctgatccgcactggtgtagtcaccgaagtggaccgggaacactggctttgtcgggtgaaaacgggcgaccttgaaaccaactggattaactggctgacgctgcgcgcgggtaatgcccgcacatggtggaaaccatcggaaggtgagcaggtggtgctactgagtctgggcggcaatctggaaactgcctttgcgctgcccgctgtctattcgaatcagttcgcaccaccgtcgacgtcggcagacgcctgcgtgacagaacatcctgacggtggctggtttgaatacgaacccgccaccgggcgctggtatgtcaggggcatcaaatcaatggtcattgaggccgctgacaacatcaccatgaaaaccagtgagtttgtactggaggctgaccgcacgcgcattaacagcgaagtggtgatcaatggtggcgttacccagggcggcggagcgatgagttctaacgggatcgtggttgatgcgcatcagcatactggcgtcctgaaaggcggcgatacaaccggaggcccggtatgacgctttatagcgggatgaacaataccagcggcaaagtcattactgatattgaccatctgcgccagtcggtgcgggacattctgctgacgccgcagggtagccgcattgctcgtcgtgaatatggttccctgctgtcgtcgctaatagaccagccacaaaatccggcattacgcctgcaggtcatgtcggcagtgtatgtggcgctgagtcgctgggagccacggctgacgctggattccatcaccatcaacagccattttgacggttcaatggtggtggagctgaccgggcggcgtaataacggtgtacctgtttccctttccgtatcaacaggagcagagaatggcagtgattgacctttcgcagttgcctgcgccgcagattgtggatgtgccggactttgatacgttgcttgccgaacgcaaggcagaatttgtggcgcttcatccgaaagatgagcaggaagcagtgagccgcacactggaactggaatctgaacccgtcaccaaattgttgcaggagaacgcttatcgtgagttgcttctgcgccagcgcattaacgaagccgcgcaggcggtgatggcggcttatgccatagggagcgatctggaccagctcgctgccaattacaacgtgaaacgcctgacggtgacgcctgctgataatgacgctgtgccgcccgtcgcggctgtgatggaaagtgatgaagcgttacgcctgcgtgtgcctgcggcttttgaagggctttcggttgcggggccaactgccgcttatgaatttcatgcccgaagcgccgacggtcgggtggcggatgccagtgcaaccagtccggcacctgcagaggtggtgctgactgtcctgagccgcgaaggcgatggaacagcagaaaaagacctgctggacgtggtggaaaaagctctgaacagtgagaacgtccgcccggtggctgaccgtcttacggttcgcagcgcagaaatcatcccgtaccgggtggaagccactatttttctctatccgggaccggaagcagagccggtaatggcagcggcaaaagccagcctgcagaagtacatcgccagtcagacgcgtcttggtcgggatattcgccgtagcgccatctttgccgccctgcatgttgagggtgtgcagcgtgtggagctggcttctcctctggcggatatggtcctgaacaaaacacaggcggcatcatgtacgcagtggagcgtaaccaacggaggaacggatgaatagtctgctgccaccgggttcaacaccactggagcgccgattggcgcaaacctgcagcgggatttctgatctgcaggtgccgcttcgtgacttgtggaatccggcaacctgtccggtcagtttcctgccttatctcgcctgggcgttctctgtggatcgctgggacgagggctggacagaaagcgtcaagcgccaggtggtgaaggatgctttttatattcatcagcataaagggaccaccagtgccgtgcggcgggtggtggagccgttcggctttttgatccacattattgagtggtggcagaccggagaggcaccgggcacgtttcgcctggatatcggcgtgcaggaccagggcatcactgaagatacctatctggaacttgagcgactgataagcgatgccaaaccatgtagccgccacatgatcggcatgtccatcaatctgcagaccagcggcccgcattgggtgggagccgccagctatcttggcgaagaaatcacgatctatccgtatatcaacgaaacgattatttccggtggcaccgcgcatgaaggcggggcggtccatgttattgacacaatgagagtgaatccatgagcacaaaattttataccctgctgacggatattggcgcggcaaaacttgccagcgccgccgcgctcggtgtgccgctaaaaattacccatatggcggtgggcgatggcggcggagtattgccaacgccggacgcaaagcagacggcactggtaaatgagaaacgccgggctgcgctgaatatgctttatatcgacccgcagaacagtagccagattattgctgaacaggtgatccctgaaaacgagggcggttggtggatacgtgaagtgggcctgtttgatgagtccggggcattgattgccgtgggaaactgcccggaaagctataagccgcaactggctgaaggcagcgggcgtacccagaccgtgcgcatggtgctgattaccagcagcacggacaatatcaccctgaaaatcgaccctgccgtagtgctggcaacccgcaagtatgtggatgataaggtactggagctgaaggtgtacgtggatgacctgatggcaaaacatcttgccgcaccggacccgcattcacagtatgcacagaaagaaagtcctacgtttaccgggacacccaaagcgccaacgccagcggcggggaataacaccacgcaggttgcgaccaccgcgtttgttcaggctgcactgacggctattattaatggtgcgccagccacgctggacacgctgaaagaaatagccgtagccattaacaatgatccgaaattcagtaccaccattaataatgcgctggcactgaaagcgccgctgttgagtccggcactcaccggaacgccaacagcccccacggcggcgcagtcggtcaacaatacacagattgccactacggcttttgtgaaatcggcgattgcggcaatggtgggttctgcacctgcggcactggatacactgaacgaactggcggcggcgctggggaatgatccgaactttgccacgacaatgcttaatgcactggcaggtaaacaaccgctggacaatacgctgactaatttgagtggaaaggatgtagcgggtcttctcgcataccttggtttgggagaaggttcggcattacccgttggtgtgcctgttccgtggccttccgccactccgccaacaggctggctgaaatgcaatggtgcggctttttctgctgaagaatacccggaactggcaaaggtttacccgacaaataaattgcctgatttacgcggtgaatttattcgtggctgggatgacggacgtggagtggatgccgggcgacaattattatcttcacagggggatgcaataagaaatattgagggattcgcagatggcgggatcggtatgtcttttgatgcaatcagaggggctttttatgatgcaggaacacgatctgcgagaatgccgaataacacaactgatataggcaaaaccgatgaccttggattcgacgcctctcgtgtcgtgccaacagctaatgaaaaccgtccacgtaacatcgcctttaattatattgtgagggctgcataatgaaacctgtttttgatgaaaatgggctggctacagtgccgggtgatatgcgttgttattattatgatgcagtaacgtctgaatatacgggctggtctgatgaatatattaatactggcgtaagtatgcccgcttgttccactggtattgacccgggcgaatacattccgggaagagtggcagtatttacgggtaagggatggagccatgaagaagaccatcgcaatgagaccgtttactcaactgaaaatggcgcagctgttacagtggattatatcggtgccatcaaagacggttatgtcacgctttcaccgttaacgccatacgataaatgggatggtgagaaatgggtgacggataccgaggcacagcatagcgccgcagtagaagctgcagaagcacagcgccagtcgctgattgatgctgcaatggcttccatcagtctgattcaactgaaattacaggccgggcggaagctgacgcagccagaaaacacccgacttaacgctgtgctggattatattgacgcggtaacggcaacagataccagcacagcgccggacgtcatctggcctgaactgccggaggcgtaggccattcaatatctggcgcaccggaagtatcgaccagttccagtgcgtccagataatccagccacaaattatattgcgccagttcctcacctttcaggcgaccaatcgccgctttaccaggccattgcttactgtttatgtattcgttgacctgattaatcaattgctgcttttccagttcggctgcggcaatttgttcctcatgagttggcggtggaatatcaatccatgcaggcattccgtcgatgacacctctgtattttccttctggtgcttccttcataaattcggcggcaacagtgtcgtcaatttcgattccatcatcgggccattcgccggattcctgataagcgattttaagctccacagggaaaaacgcatttttatcggcgctgaaaatatatttctgcatttctaccgtcctatcgaaatataactgaatctgtattgctgtgagatatcactggttgccacacgccacgctgaattactgatatgttcaaaatttacagacaaaacctgcggagcaggaatcgacgggtctgactgaacgttatcagacataacactgactgaaaccatcggctgattagggaatggtatagggaagtgtccactgataaagcgggtcgtgtttcctgaaaaagtgccaaactgaacaatatatccacctggtagcctgaaccatcccgaaccagaagcgaatgctcccatatccggtatctgattatctcctgtgcccacattccgttttgccgcttctcccaaaccaacgtttatgaaaatgcagagataacggctaactggcatcatctccggtttttattcagggggatgatcatgcttattggctatgtacgcgtgtcaacaaatgaccagaacaccgatttgcaacgcaatgcactgagctgtgcgggatgtgagcggatttttgaggataaaatcagtggcaccaagtccgacagaccggggctgaaaaagctgctcaggacactatcggcaggagacacgctggttgtctggaagctggacagactggggcgcagtatgcggcatcttgttacgctgatagaagagctgcgccagcgtggcgtgaatttccgaagcctgactgacagtattgataccagcaccccaatgggccgtttcttttttcatgtcatgggtgccctggctgaaatggaacgcgaactgatagttgaacgtaccagggcggggctggctgcagctcgtgctaaaggcagagtaggtggacgccgtcctaagttgaccagcgaacagtgggcacagattgggcgtttactcgaggccggagaatcaagacagcgtattgcactgatttttgatgtaggcgtttctatcatttatcgaaaatttccggcaaataagaacaataaatctccctgaatcagctttattttgattatccctgaaagcagacaaataccgtcattttgtgtgaataacggtacaactgcgcttagctgtttgtcaggcacaatcacttcaacatagggcgaagcctaatccaatcaggaggttcgccactatggctcaggattaccaccacggggtgcgcgttgttgaagtcaacgaaggcacccgatccattaccacggtgagcaccgccatcgtgggtatggtctgcacgggcgatgatgccgatgcaaaaatgtttcctcttaataaacccgtgctgatcactgatgtgctgactgccagcggtaaagcgggtgagtcaggcacgctggcccgttcgctggatgccatcgctgaccaggcaaaacccgtgaccgttgttgtgcgtgtgccgcagggtgaaacggaagaagaaaccacgaccaatatcatcggcgcagtgaccgctgaaggtaaaaaaacaggcatgaaagccctgttatctgcccagtcacagtttggcgttaaaccgcgcattctcggcgtgccaggccacgacaccaaggcggtagctactgagttgctgagcgtggcgcaaagcctgtgtggatttgcttacctgtcagcgtatggctgcaagacggtacaggaggcgatcacttaccgtgaaaacttcagccagcgcgaagggatgctgatctggcctgactttactggctgggacactgtgctgaatgccgaagcaacggcatatgccaccgcccgtgcgcttggtctgcgcgccaaaattgacgagcagaccggatggcacaaaagcctgtccaacgtgggcgtgaacggtgtcaccggaatttctgctgatgtgttctgggatctgcaggacccggcaaccgatgcgggactgctgaaccagaacgacgtcaccacgcttgtgcgtaaagacggtttccgcttctggggttcccgctgcctgagtgatgacccgctctttgccttcgaaaactacacccgcacggcgcaggtgctgacggacacgatggcagaagcgcacatgtgggcggtggataaaccgctgaatccgtcgctggcccgcgacattatcgagggtatccgcgccaaaatgcgcagcctggtcagtcagggctatctcattggtggtgattgctggctggatgagtcggtgaacgacaaagacacgctgaaagccggaaaactcaccatcgactacgactacacgccagtgccgccacttgaaaacctgatgctgcgtcagcgcatcaccgatcagtacctggtgaatttctccagccaggtcagcgcgtaaggggacaacatggctttaccacgcaaattaaaacacctgaacctgtttaatgacgggaacaactggcaggggatcgttgagtcgctgacgctgccgaaatttacccgcaaatatgagaagtatcgcggcggcggaatgccgggtgcagtggatgtggatctggggctggatgacggcgcactggatacggaattttccattggtggtactgagctgctgctgtttaagcagatgggcaaagccacggtggatggcatccagctgcgctttaccggctctattcagcgtgatgataccggggaagtgcaggccgtggagcttgtggtgcgtggacgtcacaaagaagtggattccggcgagtggaagacgggcgaaagcaacaccaccaaagtgaccagtaccaacagctacgcgaagctgaccatcaatggtgaggtgctctatgaagtggacctgatcaacatggtggaaattgtggacggtgtggacctgatggaagcgcaccgtaacgccctcggcctctgatgtatctgaacggcgtgggataccgcgccagaacccaatttacaggacagcaaaatgagcgataagaagactgaaaagaccattcaactggatactcccatcaagcgcggaaaaacggaaatcaccgaaattgtgctgcgtaaaccgcagtccggtgcgctgcgcggtacacgcctgcaggccattatggatatggatgtgaacgcgatgatgaccgtgatcccccgcatctccagcccggcactgactgcacaggaaattgcagagatggacccggcagatctcactgccatgtcggttgaggttgtcacttttttgttgaagaagtcggtgcttgccggtttaccgacagcctgacggttgacgatctggtggcagatatcgccaccatttttcactggccgccatccgttactgacgttatgccgctgaccgaagtgctggaatggcggtataaagcgattcagagaagcggggccaacgatgagtgataacaacctgcgtctgcaggtcattcttaatgcggttgacaagctcacccgcccatttcgatctgcgcaggccagttcaagagaactggctgctgctgtcaaaaaatcccgcgatgcaataaagcagcttgatcaggccgggagcagtctggacagcttccgaaagctgcaggcagaaaatcagaaattaggcgacaggctgaactatgcccgccagcgtgcaaatttgctcagtcaggaactgggagcgatggggccgccttcgcaacgtcaggttgttgctctgggccgtcaacggctggctgttcagcgcctggaagaacgccagaaaaagctgcagcagcagacggcgcttgtgcgtgctgaactgtaccgggcgggaatttctgcgaaagatgatgcgggagcaactgcccgtttagcccgtgaaacatcacgttataaccaggaactgtcgaaacaggaggcgcggctgaagcgactgggggaagctcagcgcaggatgaatgtggcgcgtgccagttatgcccgttcgctggaggtgcgcgatcgcatcgcaggagccggagccaccaccacggcggcagggctggcaatggggacgccagtgatggcggcagtaaaaagctataccagcatggaagatgccatgaaaggtgtggcaaagcaggtcaatggtctgcgtgacgataatggcaaccgcactgcacgtttttatgaaatgcaggatgccatcaaggctgccagcgaacagttgccgatggaaaacggtgcggtagacttcgctgcactggttgaaggtggtgcgcgcatgaacgtcgcaaaccctgacgacagctgggaagaccagaaacgtgacctgctggccttcgccagtacggcagcaaaggcggcaacagcctttgagctgccagcggatgaactgtcagaaagtctggggaaaatcgcccagctctacaaaatccctacccgcaatattgaacagctcggtgatgcgctgaactatctggatgataacgccatgtcgaaaggggcagacattattgatgtcatgcaacgtctgggcggtgtggctgaccgtctggattatcgtaaagcggcggcgctgggttccacctttctgacactgggcgctgcgccggaggttgcagccagtgcagcaaacgcgatggtgcgtgaattgtccattgccaccatgcaaagcaagagtttctttgaagggatgaatctgctgaaactcaatcctgaagttattgaaaagcagatgacgaaggatgcgatgggaactatccagcgtgtgctggagaaggtgaacgcactgccgcaggacaagcgtctgtctgccatgaccatgttgtttggtaaagagtttggcgatgacgcggcgaaactggcaaacaacctgccggaactgcagcgccagctaaaactgacagcgggcaatgatgcgctcggctccatgcagaaagaatccgacattaacaaggactcactttctgcgcagtggttgctggtcaaaaccggagcgcagaacaccttcagcagcctgggcgaaacgctgcgccagccgctgatggatattctgtacatggtgaaaagcgtcacgggagcatcgcgtcgttgggtggaagctaacccggaactgacgggcacactgatgaaagtagccgctgtggtggctgccgttaccgtgggcctcggcaccttagcggtggcgctggctgcagtgctggggccgctggcagtcatccgtctggggttctctgtgctgggtatcaaaacgttaccttccgttacggcagcagtaacccgaactagcagcgcgttgtcctggctggctggcgcaccactggcactgctgcgacgcgggcttgcttcatcgggcaacgctgcgggtttacttactgcgccgttgtcgtctttgcgccgcacggcatcactgacggggaatgtcctgaaaactgtagcaggtgcgccggttgcacttttgcggtctggattatccggtttacgtgctgttgctgtgatgtttatgaatccactggcagcactacgcggtgggctggctgccgcaggcgcggtgctgcgtgtgctcgcatccggcccgctggcgatgttgcgcattgccctgtatgccgtatctggtctgttaggtgctctgctcagtccgataggtcttgtggttactgcactggcgggcgtggcgctggttgtctggaaatactggcaacccatcaccgcatttctcggtggcgtggtggaaggattcaaagcggcggcaggtcccatcagtgcagcattcgaaccacttaagcctgtgtttcagtggattggcgacaaagtgcaggcgttgtggggctggtttactgatctgctgacgcccgttaagtcgacctctgccgaactgcagagcgcagcggcaatggggcgacgattcggggaggcactggcggaagggctgaatatggtcatgcatccgctggactccctgaaatccggcgtttcctggttgctggagaaactcggtattgtcagtaaagaggctgcaaaggcgaaactgccggaaagcgtgacgcgtcagcaacctgcgacggtgaatgcagacggtaaagtgatgatgccatcaggtggttttccatcatggggatatggttttgcggggatgtatgacagcggtgggtatatcccgcgcgggcagtttggcattgtcggtgaaaacgggcctgaaattgtcaacggcccggcaaacgtgaccagccggagaaatacagctgcactggctgccgttgttgccggaatgatgggtgttgctgccgcgccagcagagcttccaccgttgcaccctttggcatttcccgcgaaaggcggtgaagcgatggtgagtcgcgcagccactgtgtcgcccgttcaacggattgaggcaccgacgcagatcatcattcagacgcagccaggacaaagtgtgcaggatattgcgcgggaggtggcccgccagcttgatgaacgtgaacgcaggctgaaggcaaaagccaggagtaactacagcgatcaggggggatacgacgcatgatgatggtgctgggattgtacgtgtttatgctgcgcactgtgccgtatcaggaactgctgtatcaacgcagctggcgacatgcggcaaacagccgggtcaaccgacgtccatccacgcagtttctgggaccggacaacgacatgctgacgctttctggtgttcttatgccggagataacgggcggcagactgtcgttgctggctctggagcagatggcagaacagggaaaagcatggcccctgattgaaggcagcggcacgatttacggcatgtatgtgattgagggactgaatcagactaaaacggagtttttccgcgatggtatgccgcgccggattgagttcaccctgtcgctcaaacgggtggatgaatccctgtccgatatgttcggtgatctcagtgcgcagctgaataatttgcaggatacggtaacgtctgccttaagcgatatcagtaaaacggtgggagggctgctgtcgtgaatttcagctctgaactgcttaacaaaggcaacaaaactcccgcattcagcatcagtattgaggggaaggatatcaccactgtgctggataaccgcctgatgagtctgacgctgacggacaatcggggctttgaagcagaccagcttgatttggagctggacgacgccgacggaaaaatcgtgctgccgcgccgtggggctgtcattacgctggcgttgggctggaaggggcagccgcttttcccgaaaggagcattcacggtggacgagattgaacacactggcgcaccggaccgcctgactatccgggcgcgaagtgctgattttcgtgaaaccctgaatacccgccgtgaaaaatcgtggcacaagaccaccgttggggaagtggtgaaggaaatagctgcgcggcacaaactgaagatggcattgggtgaagacctgtcggataaacccgtggagcatatagaccagaccaatgagagtgacggcagttttctgatgcggctggcgcgccagtacggtgctattgcgtcggtgaaaaatggcaatctgttattcatccggcagggacagggtaaaagcgccagcggtaaaccactgccggtgatcactatcacacggaaggacggcgacagtcaccgctttaccctggcagatcgcggagcctacacgggcgtaattgccagctggttgcatacccgcgaacccgcgaagaaagaaagcaccacggtgaagcgtaagcgcaggactaagaagcagaagaaagagccggaagcgaagcagggcgattacctggtggggacggatgaaaacgtgctggtacttaatcgcacttatgccaaccggagcaacgccgaacgagcggcgaaaatgcagtgggaacgcttgcaacgcggcgttgcgtcattctcgctacaactggcggaaggtcgggcagatctctacacggaaatgcctgtgaaggtcagtggctttaaacagccgatagatgatgcggaatggaccattaccaccctgacacatactgtcagcccggataatggttttacgaccagtctggagcttgaagtgaggattgatgatttcgaaatggaatgattcttcgcaatggagaacttttaagtttgcaaaatggaataatgcggtatcattattgtgaatttagcaaaaatggggagagctcgaaaaatgatgatttgcccactgtgtggaagtgccgcccatactcgcagcagttttcaggtatcttcattgaccaaagagcgttacaaccagtgccagaacattaactgcagccatacttttgttacccatgaaacttttgttcgttcgattgcaacgccaaaagagtcaaatccggttcagccgcatccaatgaaatcaggacaggtggcgctctctctttgacgctgccgccattttgtcgccatcgttaaaaaacagtgtttctaacatcatgattttaaacagcttaaatttcaggcaacaaaaaacccattaaccttgctccagccgatctaccgaaagagggcggaaggtatgacctgcctattgctgttgcgcttctggccgcgtctgagcagcttacagcgtcgaatcttgaggcatatgagctggtgggtgagttagcgcttacaggcgcattacgcggcgttcctggcgcaatatcaagtgcaacggaagccatcagggccggcagaaatattatcgtcgcaacagagaacacggcggaggttgggcttatcagcaaagaaggatgttttatcgccgatcatctacaaaccgtctgcgcctttctggaagggaaacacgccctggaaagacctttagctcaggatatggcatcgtctaccgcaactgccgatcttcgcgatgtgatcggtcaggagcagggtaaacgcggcctggagattacagcggcagggggacataatctgctattgatcggcccgccgggtacgggtaaaaccatgctggccagtcgactgagcgggattcttccaccattaagcaatgaagaggcgttggaaagcgccgcgatcctcagtctggttaatgccgatacggtacaaaaacgatggcagcaacgtccctttcgctcacctcatcatagcacctcacttactgctatggtcggcggcggcgcaatacccgccccgggagagatatcgctggcgcacaacggaattttgttccttgatgaattgcctgaatttgaacgacgcacactggatgcgctacgtgaacctatagaatccggtcaaattcatttatcccgtaccagagcgaaaataacgtaccctgccaggttccagttaatcgccgcaatgaatcccagcccgaccggacattatcagggaaaccataatcgctgcacgccagaacagacactacgttaccttaatcggttgtcaggcccgtttcttgatcgttttgacctttcgcttgagataccgcttcctccgcccgggattcttagccaacacgcctcaaagggtgagagcagcgctacggtaaaaaagcgggtcatcgccgcccataaacggcagtaccgacgccagaagaagttaaacgcgcgtctggagggtcgcgaaatccaaaaatattgtgttttacatcacgatgacgcccgctggcttgaagacacgctggtgcatcttggattatccattcgcgcctggcagcgtttactaaaagttgccagaaccattgccgacatagaactggctgaccagatctcgcgtcagcatttgcaggaggcggtaagctatcgggcgatagacaggttgttaattcatttgcaaaagctgttggcgtaaaaaaagggcattacgccctttttattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgccaaaataccgaagacaggcgttctacggagagaagcgtagagcggtaggcagcattttaaggaaactatgtgagtggaaaaatgtgaacattctggaagcggaatgctgtgcagatcatatccatatgcttctggagatcccgccgaagatgagcgtgtcagggtttatgggttatctgaagggaaaaagtagcctgatgctttatgagcagtttggcgatttgaaattcaaatacaggaacagggagttctggtgcagagggtactacgtcgatacggtgggtaagaacacggcgaagatacaggattacataaagcaccagcttgaagaggataaaatgggtgagcagttatcgatcccttatcctagcagtctgtttacgggccgtaagtaacgaagtttgatgcaaatgtcagatcgtatgcgcctgttagggcgcggctggtaagagagccttacaggcgcatcagaaaaacctccggctatgccggaggatatttattaatcatcagcttcggtgtagtcttctgcgccttcaacttgcggcttgccgccagacaaggtgtggaagcgttttggacgcttgatacgcgtcatatacttggaccagacgcgttctgcatccgttaccggctcgcgttcaccgcgacataccgctacaaacagcttctcttcttcagtcacaggctcacgcttgccaagatccagatcattaaaggcatgaccatgacgctcaagcagttgtgcctctttaatcgtgaaatcaccgtgacgagagaatccacgtggataatgtttattgtcaaaatatcgattagtcgtcgtaaagctttccgccatcctgcacgctcctaattctttgtctgagctatttatggcgcggagtattagttacgcttgacagagtgtaaaacaaaacatttaaatcataacgacaaataattttgtggagagcacagtggatacggaattgttaaaaactttcctggaagttagccggacacgccatttcgggcgggccgcagaagcactttacctgacgcaatccgcggtgagctttcgtatcaggcaactggagaatcaactgggcgtaaacctttttacgcggcacagaaacaatatccgtttaaccacggctggcgaaaaacttttaccgtatgcggaaacgctgatgaatacgtggtaggcggcacgtaaagaggtggcgcatacctcacgccataacgagttttccatcggcgccagcgcgtctttatgggagtgtatgcttaacgcctggctgggtcgactgtaccaactacaggagccgcaaagcggcctgcagttcgaagccagaatcgctcaacggcaatcgcttgtgaagcaacttcatgaacgccagcttgatctcctcattactaccgaagcgcccaaaatggatgagttcagcagtcagctgttagggcacttcactttggcgttatattgcagcagccctgcccgtaagaaatcagaactcaattatctgcggctggagtggggaccagacttccaacagcatgaaacagggctgatcgcagcagatgaagtaccggtattaacaaccagctcagccgaactcgcccgacagcagcttagcgcattaaatggctgtagctggcttcctgtaaactgggcaaatgaaaagggcggattacataccgttgccgacagcgcaacgctttcacggccgctatacgccatttggctgcaaaacagcgataaatactcgctgatctgcgatctgttaaaaacggatgtgctggatgaacaatgaaaatgatgaaaagaaaaagaagggaacttacgattacctgatcagataatcaggtaatttcaggcaaaaaaaaatccttagcagatgctaaggattatttctggcaggggcggagagactcgaactcccaacacccggttttggagaccggtgctctaccaattgaactacgcccctaattagggtggcggaacggacgggactcgaacccgcgaccccctgcgtgacaggcaggtattctaaccaactgaactaccgctccaccgaattcttttacaaccactgatttttacatcaatttactgcttaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaatatctcaaacgtgactcgtaagtcagttttgagatactgatggcaacgcctttcacacattaccgcgcaagtggcgtcccctaggggattcgaacccctgttaccgccgtgaaagggcggtgtcctgggcctctagacgaaggggacgtatcagtctgcttcgcaagacgccttgctattcacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgcccccccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtatattacgctttcctctttcagagtcaaccctgaatttcaggatttttctcttcaaccgaccggctgtttgtgtgaagtgattcacatccgccgtgtcgatggaggcgcattatagggagttatctgctgaccgcaatagaaaaattgcagaaaaatgactgtttgctgcattccccagcaaaacccttggttatacccatttacgcacagacttatccacaaaatgcgcgttcatttcctcgatcttctcactctgcaaacgatctttcagggataaaagcggggccagaatttaaagagaaaaattcgcgagcgttgcgcaaacgttttcgttacaatgtcgccgcaaaatgagaatgccccataaggagcgttagctgagtttttcacgaaaaattcagctaacgctctctataatcgtcaaatccaggggatttaccatgcaacaacgtcgtccagtccgccgcgctttgctcagtgtttctgacaaggccggtatcatcgaattcgcccaggcactttccgcacgcggtgtggagctgctgtctacggggggcaccgcccgcctgttagcagaaaaaggcctgccggtgaccgaagtttccgattacaccggtttcccggaaatgatggatggacgcgtaaagaccctgcatccaaaagtacacggtggcatcctcggtcgtcgcggtcaggacgatgccattatggaacagcaccacatcgcccctatcgatatggttgtcgttaacctatatccgttcgccgaaaccgtggcacgcgaaggctgctcgctggcagatgcagtagagaacattgatatcggcggcccgaccatggtgcgctctgctgctaagaaccataaagacgtcgccatcgtggtgaagagcagcgactacgacgccattattaaagagatggatgctaacgaaggttctctgaccctcgacacccgtttcgatctcgcgattaaagccttcgaacacaccgccgcctacgacagcatgatcgccaactacttcggcagcatggttccggcctaccacggtgaaagcaaagaagccgccggtcgcttcccgcgtacgctgaacctgaacttcattaagaagcaggatatgcgctacggcgagaacagccaccagcaggctgccttctatatagaagagaatgtgaaagaagcatccgttgccaccgcacagcagattcagggcaaagcgctctcttataacaatatcgccgataccgatgcggcgctggaatgcgtgaaagagttcaacgagccagcctgcgtgatcgtcaagcacgccaacccgtgcggcgtggcggtaagtacctcgattctcgatgcttatgaccgtgcgtataaaacagacccgacctccgcgttcggcggcattatcgccttcaaccgcgagctggatgccgaaaccgcgcaggccatcatctcccgtcagttcgtggaagtgctcatcgccccatccgcaagcgaagaagcgctgaaaatcacctcagccaagcagaacgtccgtgttctgacctgcggccaatgggcaagccgcgttccgggcctggatttcaaacgcgttaacggcggtctgctggttcaggacagggatctgggtatggtgagcgaagctgaactgcgcgtggtgtccaaacgccagccgaccgagcaggaactgcgcgatgcgctgttctgctggaaggtagccaagttcgtgaaatccaacgccattgtgtatgccaaagagaacatgactatcggcataggcgcaggccagatgagccgcgtgtactccgcgaaaatcgctggcattaaagcggctgacgaaggtctggaagtgaaaggctctgctatggcttccgacgcgttcttcccgttccgtgatggcattgatgccgctgccgctgtcggcgtgagctgcgttatccagcctggcggttctatccgtgatgatgaagtcattgccgccgccgacgaacacggcattgcgatgatcttcaccgacatgcgccacttccgccattaattcagggagcagacgatgaaagttttagtcattggtaacggcgggcgcgaacatgcgctggcctggaaagccgcacagtcgccgctggttgataccgtttttgtcgcaccgggtaacgccggtaccgcgctggagcccgcgttgcagaacgtggctatcggcgtcaccgatattccggcgctgctgagctttgcccagaacgagaagattgatctgaccatcgtcggtccggaagcgccgctggtgatcggcgtggtcgatgcgttccgcgcggcgggtctgaagatctttggcccaaccgaaggagccgcgcaactggaaggctccaaagcgttcaccaaagatttcctcgcccgtcatcagattccgacggcggaataccagaatttcaccgagattgagcctgccttggcttatctgcgtgagaagggcgcgccgatcgtcatcaaggccgatggtctggctgcgggcaaaggcgtcatcgtggcgatgacgctggaagaagccgaagccgccgttcatgacatgctggcaggcaacgcctttggcgacgcgggccaccgtatcgtgattgaagagttcctcgacggcgaagaagcgagctttatcgtgatggtcgacggcgagcacgtgctgccgatggccaccagccaggatcacaaacgcgtaggcaacggcgataccggcccgaatactggcggcatgggtgcttactccccggcgccggtggtgactgatgaagtgcaccagcgcaccatggaacgcatcatctggccaaccgtgaaaggcatggcagcagaaggtaacacgtacaccggcttcctgtatgcgggtctgatgatcgacaagcagggcaacccgaaagttatcgagttcaactgccgcttcggcgatccggaaacccagccgatcatgctgcgcatgaaatcggatctggtggatctttgcctggccgcctgtgacggcaagctggatgagaaaacctccgagtgggacgaacgcgcttcattaggcgtggtgatcgccgcgggcggttatccgggcagctacagcaccggcgacgagatccacggtctgccgctggaagaagtggctgacggtaaggttttccacgcgggcaccaaactcgccgatgacgaccgcgtgttgaccagcggcggtcgcgtactgtgcgccaccgcgctgggccacaccgtggccgaagcgcagaaacgcgcttacgccctgatgaccgacatccgctgggacggcagcttcagccgtaacgacattggctggcgcgccattgagcgtgagcaaaactaacggctgagtttagccagcagcgttttgcgcgtaatgcccaattgacgggcggcttccgttttgttgccgcccgttttttccagcgccgccagaatcacctctttctccacatcgaccaacggttggatttcggcgctgttttccgcttttatcggcgtcgcggcaatagcgagaggcaattcgcgttcagaaatgtattctcccgtcagcaacaccaccgctcgttcgatagcgttttccagctcacggatattacccggccagtcgtagtggatcagcagatccatcgcctgcggcgtaaaccccttcaccgcttttcggttacgttcggcaaaacgccgcagaaaatggtctgccagtagcggaatatcttcccgacgctggcgcaaagaaggcatttcaatcgccaccacattcaggcggtaatagagatcctggcgaaagcgaccggcactcacctcttccgccaggtcgcggtgggtagcggcaattaaccaaacatccacagatatcgtctggttacttcccacgcgttgcacttcgcgctcctgaatcgcccgcagcaaacgtacctgcattaacggcgagatatcgccgatttcatcaagaaacaatgtcccgccgtcagcttcgacaaagcgtccctcccgacgtttatccgcgccggtaaacgcgcctttttcgtgtccgaacagctcagactccagcagcgattcattaagcgccgcgcagttgagcgtgaccagcggtttatcgctcctggcgctacaggcgtgcagcgcccgcgccaccagctctttacccgtgccggagtctccgtgaatcaataccgtggcgtctgatggtgcgaccatcgcgatttcattcaataaatgttgcatcgccgggctgctgccaatcatgccaaattgcgcagccgacgccgatggcaattcagcgcccgtttcccgcgtatgcgccaacgccttttccagcgtctcctgcagacggtcaaaatccagcggtttaattaaatagtcgagcgcgccggctttcaacgcctctaccgccgtttccacgctggagaatgccgtcataatcaaaatcggaatggcggggttgagcgctttaatctccttcagcgtggcgataccgtccatctccgccatacgcacatcgcacagtaccagatcaaagactttctcacgcacctgagccaacgcatcatgcccactgtaggccagagcgacgttatagccccagccccgaagcagcgcctgtaaaatcgtgcagtggcttacatcatcatccacaaccagaatatcgatttttccgcgtatcacccttgttaattctgttgtctcgctatcactggcaaccagatagtaaagaccgcgcctttaccctcaatacttttcaccttaatcgcgccgccatgctgttcgatgatattttgcaccaccgccagccccaggcctgtcccgtcagctttggtcgtaaaataaggtgtaaaaatcgcctccagctgatccggggcaatccctttcccgctatcggtaacagtgatgataacgcggtcggtcccactttcttttgcctctacggtaatcgttccctggcggccaatcgcatgaatagcgttcaggtacaaattcaacagcacctgagtcagcctgtccgggtcagcctgaatacgcttaagcgtctcattcgccgtgaatctcaactgaatctctctgctttgggcatcctgactgaccagattcagggagtgagtaataatatcattgaggttaaccgcctggagcgtcagatgcgcgggctttaccagttcgagcaattcgcttaccacccggttcaaacggtcggcctctttggccatcacctgcgccagttcatgcgactcgccgccggcaggcgtgcgctcggcaaagtatttcgccagccctttgatggacgagagcgggttacgaatttcgtgcgcgacgcccgccgccagatgccccatcgccaccaacttttctttacgcttcattgcatcaagcagttctctgtgcgagcgctgataacgctgataccaaaaaaacgccagtaacgttgccaacagcaccgccgctaacgcagacaaaacaatcagcgtattacgccactcccttgcctgagtcgcggccagctcgctggcgtcaaaggcaataaaaatagtttgtttcgctggttcgtcgtcattggcgctacgcgccatgccgtgccccctcatactgtgacctctcataccgaaaagcggctggaactgacggtaaatttccagcgcaggcaccgtctcgccgttagcagcaacgtcgacacgccgccaacactcctgcggcccggggtttagttgatgcatttcagatggggaatagagcgacttgcccaccatgccagggttgctatgagtgatgattaccccctgtgcatccgttacagcgaatcacaacacgcctggctgacccgccatctcttccagcaatgtctgctgctgcgcgtgatgcatccgcattcccatacctactcgcgtgccggactccagagcgcgaatgagtacatttcccttttccagcagcgtctgcctggcggcagcgctctcacggccatagtcgcgaatgaccataatggaaaatagccccaccagaatgaagatcgccgcaggtaacagccgactcaaccacattgcagcggcatctttatgtaatcgtataaaactcacaggcttccccggctcgtttttattttccttacttaagcagagatcatgccattcttcgctccgcataaccgcgcgttgtcgcacaccctttcggatacggatgggtaaaaatgactcgccaggcgggtcatgcgagtcatttttactcgctttttgccgcctgaagcgggttaactcgctgcccgacaaggaatagttacctggcacggaagatgcaagagagaggataagatgagcaacaggagaacgcaaaatgaaacggaacaataaatcagctatcgcgctaatcgccctctctcttttggccctgagctccggcgccgccttcgccgggcatcactggggcaacaatgacggtatgtggcaacagggaggtagcccgttaaccacggaacagcaggcgacggcgcagaagatttatgatgattactatacgcagaccagcgcgctgcgccagcaactgatatccaaacgttatgaatacaacgcgctactgatcgccagttcgccggatactgcgaaaattaacgcggttgccaaagagatggagtcattaggccagaagttagatgagcaacgcgtgaaacgggatgtcgcgatggcgcaggctggcataccacgcggcgcaggaatgggctatggcggttgcggcggctatggcggcggttatcatcgcggcggcggtcatatgggtatgggaaactggtaaagcatgtttgccgaatggcggcttcgccattcggtattccatcaaaaggttttcgcttgcggctgccagtgacagaaatctgaattcgccaccagcaaaagttgcgatccttccggcgcctccagccatgctacgctcacctctaccgatgagtggttctggcggcgctcaatgtggcttattgtccaagaatccagatccggtttcagcgtttcaccttcacaggtggttatcgtatggtcggcgtgccagcgtccctggcgtagtatgacccgccccaggcgcaatgcgtcgctggtctgacggatttgttcggcacgatagcgatacaaggcaatctgatcgttggaaagctgctgcttctgccccccgatttcacgctgcataaaactgagttcgccatgagcgtcgaaacgcgcgcgaatatgttctggcggtttgctgtaaatattgagttcaataagcgaaagcgtatcaccctgccaacgatattcgctggtcgtcgtgctaccactatgccacgggctaaaaacagaaagcagatggacttcatcgttcgtatctttacgccagatacgcaccgcgccgtgatcgccggcaaagccgctggcagtaaacggaggcggtgaagcgttatgactgcaggcagtcagcaacagcgcgccagaaaacagaaacgcgtgacgccagacggacaaaaggggctgacaagccccttcgataaaactgttcacagttacgcgtcttacttaactgcgtctttcagagctttaccagaaacaaacgccggtacgttagcggcggcgattttgatttctttaccggtctgtgggttacggccagtgcgctcagcacggtggttcactttgaaggtaccgaaaccaaccagttgtacagcatcgccttctttcagagactcagtaatagcagccagagtggattccagagcagctttagcctgggttttggacagttctgctttgtctgcaattacatcaatcagttgagtcttgttcataagttatccttacaatgtgtttatcgcttgctaagcatcgagtgcgacggaaatgccagaaaagcactctcctgcatacacgcaccgatagccactttttttcgcctcccaaatgtagaccagacggggggcataagggaagccttatggcacgacaaatcagacgttaaatcacgttttctggtgtcattgctgaaaatttataccgatattgctctcgccagcctcgcgcaggtctgccctgagcccttttatcagttcaatatcacgttcttcgcagtcggctaaaagtcggaatatttcccactgaatatcccattcctgttcaacggcagggttcgttttgagctcctcatcggtcatttcccgaccagcctgagtcatttccaacatcgctaccgtagtaatggaagtcttactaacctcaatagcatgttccagcgtttcgccgctaagacgagaatgcattaattcgcttaatgcgacgcaggcatcaatcgccgggtaaacgccgtacaaatcatagtcgtcggctgccggaattgcctcttcaaacttctccagttggctatcgaaattgacctttgcatctttcaccgtcagggtttcccagatcagatccagaatgcgacggtagatctgtccgtcgccgaattccgtctgcttgcaaaacatggcgtagttcgggtacatgcgctcgcacaagcaggccataaaggtaacgtgctgccaactttccagccgctccagccgcaaatgaatcgggttttgtaacatgatggaatctcgaatcggaaattagcggcagtttacctgaatcagcgctgaatttcttgccaacgaacaaacgccggacgcccggaagcgacggcatccgcccagcgcgtcggctccggcaggcgataccctttcatacagcgctgtacccacgccagcgcgctgtcagtactgacccggtgccctgtcgcgataaacagcggattacagcgcgccttgctgcgccatacccacgccagttgctcgcctttatccattaaggggctaagtgcgccaggttcggcggaaagtggttcaaatttaccgcatagccgttttttcgccacgccgatggtcggcacgtccaccaacagtccaaaatgactggcgacgccaagccgacgcggatgcgaaataccgtgaccgtccacaaacagcaaatcgggcttttgcgagagctgttcccacgctgccagcagcgcaggatattcacgaaaagagagaaagccggggatatacggcatggtggtggcaatacgcgccaccttgtactctactagctcaagcgacggatatttcagcaataccatcgccgcccgcgtcacctcgccgccctgctcaaaaccgacgtccgccccgccgataaacgctggcggatctttgtccaggcgatcttcgcggcaaactgatgaagcaagttctatctgttgagcgcgtagcgacgcgagatccatactaactccttagttgtgatactgcgcagaaagtcggtgcactgcctccacaaatgcgccagcatgttctggcggcacatcctgatggatgccatgtccaaggttaaagacgtgcccttctccctgaccgaaaccagcaagtatagtcgctacctcgtcttcgatccgtgccggcggcgcatacagcatggacggatccatattgccctgcagcgccactttatggccaacgcgacggcgcgcatcggcgatatctgtcgtccagtcgagacccagcgcatcgcagccggtttccgccatcgcctccagccactgaccgccacctttagtgaacagcgttaccggcacgcggcgaccgtcgttttcacgcagcaggccatcgacgattttatgcatgtagtagagggagaactgctggtaatcgcggccagtcagcacgccgccccaggtgtcgaaaatcatcaccgactgcgcgcccgctttgatttgcgcgttgaggtacagcgtgacgcttttcgccaacttatccagcagcagatgcaacgcctgcgggtcagcgtacatcatctttttaatcaccgtgaaggctttgctactgccgccttccaccatgtaagtcgccagcgtccacgggctgccggagaagccgatcagcggaacctcgccttttagttcgcggcgaatcgtgcgtaccgcattcatcacgtagcccagttcatcctccggatcgggaatgggcagcttatcgacatcggctttgcaggtgacaggggccgtaaagcgcgggccttccccggcttcaaaatagagccccaggcccatcgcgtccggaatcgtcaggatatccgagaaaaggatcgccgcatcaagcggataacggcgcagcggctgtaaagtgacttcgcaggccagttcggcatttttgcacagcgacataaaatcgcccgcctgagcgcgagtggctttgtactccggtagataacggcccgcctggcgcatcatccacactggcgtaacatcaacgggctggcgcagcagcgcacgtagataacgatcgtttttgagttcggtcatttttacattcctttagcgttgatgcgcccagtgtaacatgtcagtcgtattcagcccgacacattgccaccgtatcttcgatcaaacggcgcgcgacggtgcccggcggcggcagtagcggcagatcgtcataacggtaccaatttgcttccaacagttctttcgggtcgatgacaatctcgccgctgtcatactctgccataaacgccgtcatcagcgactgtgggaacggccacggctgcgaggtcacgtagcgcagatttttcaccttgatcccgctttcctccatgacttcgcgcgccacagcctgctccagggtttcgccgacttcaacaaacccggccagtaccgtatgcacgccgttgcggtggcgaacgtgccgggcaagtagaatagaatcctcacggcgaatggcaacaataatgcagggggcgatttgcgggtagtaacgatcgcggcaatggctgcacagcatcgcccattcggttttactcgggtgcatagggtgcccgcaatagccgcaaaatttatgcgaacgataaaactccgccaactgtacgccacgtcccgccagttgaaacagcccggcatcctgatcgataacctggcgaaccgatcccatatcatgacgtcgatgctgtaacaccagccagacgggctcgccttgccattcacctatccggagtgcgcgctgccccacaagatcgaaatttgccgccagcccgtgtggtaattccccatacggcaaccataatttttgttcatggctgacgatccaccagccactctctaatttttcaattatacgatccatagctattgcactacctttgcttcactggcatgttgttaacattatttttacattcatggcgagcagcctttatctaacttgcggagacaatcatgctaaaccagctggaaaacctgatggagcgcgttggcggaagcaacaaactggtcgatcgctggctggatgtacgtaagcacctgctcgtggcttactacaatctggttggcattaagcctggcaaagaatcgtacatgcggctgaatgaaaaagcgctggatgatttttgtcagagcctggtcgattacctttccgccgggcacttcagtatttatgaacgtattctccataaattggaaggaaacggtcagcttttacatgcggcaaaaatttggccgctgctggaagataatacgcagcgcattatggattattacgacaccagcctggaaactgccatcgatcacgataattgtctcgaatttcaacaagctctgtcagatatcggcgaagcgctggaagcccgctttgtgctggaagacaagctgattatgctggtgtttgacgcgatgcacgacggcgccagagtcaaacgtcccgcttgagttctgcgcgagtaacaggtagtttacttcagccccctcttcggaggggcggttatcttgtcggagtgctaattttccacaaaagcgttcgtgatgcgtcaaggcggcaagtcggtgaatctccaggagcttacataagtaagtgactggagtgagcggacgaagccaacgaagaggcagcgcgaaggatgaagtggaaaaggctgagaccgttaattcgggatccgcggaacctgatcaggttaatacctgcgaagggaacaagagtaattctgctttatgctgctgcctttacgggcggcgcacatccattactccatccgtcgtctgacaagccacgtccttaattttttggaatgagctatgtctacaacaacgttaacccgccgcgagcagcgcgctaaagcccagcattttatcgatacgctggaagggactgcctttcccaactcgaaacgcatctacgtgaccggttcgcagcatgatattcgcgtaccgatgcgcgaaattcaacttagccctacgctcatcggcggcagtaaagacaacccgcagtttgaagagaacgaagccgtaccggtatacgacacctccggcccctatggcgatcctgaagtggcgattaacgtccagcagggtctggcgaaactgcgccagccgtggattgacgcacgtaacgatagcgaagaattagacgaccgtagctcggcttacaccagagaacgtctggccgacgatggcctggacgatctgcgttttaccggcctgctgacgccgaaacgcgctaaagcgggcaagcgcgtcacccagttacactacgcccgccaggggatcgtcactcccgaaatggagttcatcgccatccgtgaaaacatgggccgcgagcgcattcgcagtgaagtgctgcgccaccagcatccgggcatgaactttggcgcgcgcctgccggaaaacattacgccggaattcgtgcgtgatgaagtcgccgcgggccgcgcgattattcccgccaacatcaaccacccggaatcggagccgatgattatcggccgcaacttcctggtcaaagtgaatgccaacatcggtaactcggcggtcacctcctccatcgaagaagaggtcgagaagctggtgtggtcaacccgctggggcgcggacacggtgatggacctctccaccggtcgctatattcacgaaacccgcgaatggatcctgcgtaacagcccggtaccgatcggcaccgtcccgatctaccaggcgctggaaaaggtcaacgggatcgccgaagatctcacctgggaagcgttccgcgacacgctgctggagcaggccgaacagggcgtcgactacttcaccatccacgccggcgtgctgctgcgctacgtgccgatgaccgccaaacgcctgaccggtattgtctcgcgcggcggttcgatcatggcaaagtggtgtctctcccatcacaaagagaacttcctgttcgaacatttccgcgagatttgtgaaatctgctccgcctacgacgtttccctgtcgctgggcgacggcctgcgccccggctccattcaggacgccaacgacgaagcgcagttctccgagctgcatacgctgggcgagctgaccaatatcgcctgggaatacgacgtgcaggtgatgattgaaggcccgggccacgtgccgatgcatatgattcagcgcaacatgaccgaagagctggagagctgccacgaagcgccgttctacaccttagggccgttgaccaccgatatcgcgccgggctatgaccacttcacctctggcattggcgcggcgatgatcggctggtttggctgcgcgatgctgtgttacgtgacgccgaaagagcatctcggcctgccgaacaaagaagatgtgaagcaggggctgatcacctacaaaatcgccgcccacgccgcggatttagccaaaggacatccgggcgcgcagatccgcgataacgccatgtcgaaagcgcgctttgaattccgctgggaagatcagtttaacctcgcgctcgacccgttcaccgcccgcgcttatcacgatgaaaccctgccgcaggagtccggtaaggtcgcccacttctgttccatgtgtgggccgaagttctgctcaatgaaaatcagccaggaagtgcgtgattacgccgccgcgcaagccattgaagtcggcatggcggatatgtcggagaacttccgcgccaaaggcggcgaaatttatctcaaacgggaggaagcctgatgtatcagcctgatttcccaaccgtgccgttccgcctcgggctttacccggtggtggacagcgttgcatggattgaacgcctgctggaggcgggcgtgcgcaccatccagttgcgtatcaaagataagcgcgatgaagaggtggaagccgacgttatcgccgccatcgcgctggggcgttgttatgacgcccgcctgttcatcaatgattactggcgtctggcaattaagcacaacgcctacggtgtacatttgggccaggaagatctcgaaaccactgacctgaaggcgattcaggcggcggggttacgcctgggcgtatcgacccacgatgatatggagatagacatcgcactcgccgctaagccttcttatatcgcgctgggtcatgtattccccacgcaaaccaagcagatgccttccgccccacaggggctggcgcagctggcgcggcatattgaacgactggcggattatcccaccgtcgctatcggcggcatcagccttgaacgcgctccggcggtactagcgaccggcgtcggcagtattgccgtggtcagcgccattactcaggctgccgactggcgcgccgctaccgcgcagttactggcaatcgcgggagtgggcgatgaatgaccgcgattttatgcgctacagtcggcaaatcctgctcggcgatatcgcgattgaaggccagcaaaagctgctcaatagccatgtattgattgtcggcttaggcggattgggttcgcctgccgcgctgtatctggcgggagcaggcatcggcacactgacgctggcggatgatgacgatgttcacttgagcaatctccagcggcaaattctgttcaccaccgacgatatcgcgcgttcgaaatcccaggttgcccagcagcacctgacacggctcaacccggatatcgaactggtatcactccagcagcgactaaaaggcgatgcgctccggcatgcggtagcgcgtgccgacgtggtgctcgactgtaccgacaacatggcgacccgtcaggaaattaacgccgcctgcgtggcactcaacactccgttaattaccgccagcgccgttggttttggcggccaagtgatggtcctcacgccgccgtgggaacaaggctgttaccgctgcctgtggccagatgatgtggagcctgaacgcaactgccgtaccgccggtatcgtcggaccggttgttggcgtgatgggcaccttacaggcgctggaagcgattaaattactcagcggtattgagacgcccagtggagagctacgcctgtttgacggtaaaaccagccagtggcgcagcctggcgctgcgtcgtgccagcggctgtccggtatgcggagggcgacatgcaaattcaattcaatgacgagccgatgcagtgcgccgaagggcaaaccgtcagcagcctactcgctacgcttaatcagcttcaaccgggcgcggcgctggcgctcaatcagcagatcctgccacgcgagcagtggcggcaacatatcgtgcaggaaggcgaccagattctgctttttcaggttattgcaggaggttgagatgttacgtattgccgacaaaacgtttgattcacatctgttcaccggtaccgggaagtttgcctcatcgcaactgatggtcgaggcaattcgcgcttccggcagccaactggtgacgctggcgatgaagcgcgtggacctgcgccagcacaatgatgcgattctggcgccgctgattgaagcgggcgtcacgctgctgcccaatacctccggggcgaaaaccgccgaagaggcgatcttcgctgcccagctggcgctcgaagcgctgggcacccactggctgaaattagaaatccacccggacgcccgttggctgctgccggatccaatcgaaacgctgaaagccgccgaggcgctggtgaagcaaggttttgtggtgctgccctactgcggcgcggatccggtgttgtgcaagcggctggaagaggtcggctgcgcggcggtgatgccgcttggcgcgcctatcggttcgaatcaggggctggaaaccaaagcgatgctggagattattatccaacaggcgaccgtgccggtggtggttgatgcgggcattggcgtgcccagccatgccgcgcaggcgctggaaatgggcgctgatgcggtgctggtcaacacggcgattgccgtggcggacgatccggtgatgatggcaaccgctttccgtctggcggtggaagccggattactggcgcgtcaggcggtgccgggtaatcgtagcacctacgccagcgctaccagcccgctcaccggatttctggaggcgttagcatgaaagccttcaccgaccgttggcggcaactggagtgggacgatattcgcctgcgcatcaacggtaaaaccgccgccgatgtggagcggacgctgaatgcttcacgcctcaaccgcgaggatatgatggcgttgctctcccccgccgccgccgattatctggaaccgatggcgcagcgggcacaaaggctgacccgacaacgctttggcaacaccgtcagtttctacgtgccgctctatctctcaaacctctgtgccaacgactgcacctactgcggcttctctatgagcaaccgcatcaagcgtaagacgctggatgaggtggatattcaaagggagtgcgatgctatccgtaaactgggttttgagcatctgctgttagtcaccggcgagcatcaggccaaagtcggcatggactattttcgccgtcatttacccaccatccgccgtcaattttcctctttacagatggaagtccagcccttgtcgcaagaaaactacgcggagctcaaaacgctggggatcgatggcgtgatggtttatcaggaaacttaccatgaggcaatctatgcacagcatcacctgaagggaaagaaacaggactttttctggcggctggaaacgccggatcggttaggccgggcaggtatcgacaaaatcggtcttggcgcgctaattggtctgtcggacaactggcgggtggattgctatatggtggcggagcatctgttgtggatgcagaaacactattggcagagtcgctattctgtttccttcccgcgtctgcgtccgtgtaccggcggtgtggaacccgcatctgtgatggatgaaaagcaactggtgcaaacgatttgcgcgtttcgtttactggcgccagaaattgaattatcactctccacccgcgaatcgccgtggtttcgagaccatgtgattcctctggcaatcaacaacgtcagcgccttctcgaaaacccagcccggtggctacgctgacgatcatccggaactggagcagttttctccccacgatgaccgtcggccagaagtcgttgcaagcgcgttaagcgcgcaagggttacagcccgtatggaaagactgggacagttggctggggcgcgcttcgcaaatgcggtgaacccgtatgtaaacgcattaatatttcacgagcgagtacgtaatgtgaaaaacgggagattgttatcggcctcccgttttttattttgtcatcgtcagcaacggaagctgaccagggcaaattatcccttcctcatttttgcccaaccttctccccttcatcagtaactgacgaccaggggctggccactggattatcgaaatagcggtgaacttgaagttttcgggcagcgttcctgactgtaatttcgctggcggcccctcttccaaccgtgtctgctgatcgtttttgtccataaaatgatgccccagaacaacgggaatcaggggcgaacccatcagggaaaaatgtgttgcggccggacgccgatagtaacgttacttgatggaaaacgcatctgggctgagaaaaatttaagccagatgtaatctgacagatatctgtataaataaccggtaactgtcagatcaggtctgagataatacatatcattttacctatacgcactacatcctcggacatctgggattggtgcattatccgattataaagtcgtctgtgtgttttttcggcctaaagaccttaatggaattgaatccttcatttaatgatttaaaatgtcccgcgtaaacaatcaataaaacaggtttatcatttaatgtatgaacagcaggcattttataatggcgagccaatagactttaataacttagatttatgggataaatttaaagtcacatttggactaaatgttacagaaaaaaccaaacccaatggtaaaaaatttcaattttgagtattgtggattctctacttttattacgccggttgatggcgttggcgggattttagcaaagtggctctcaaacaaacataatgtaagtgtcccaacgccttatacattcggtcaggaccccattcctggcatcaatctttatcgtaatacaaaagcaaaatttgttatggctaacggtggtaatagtcttccctgtgcgatatcaaaatataatgcaaaaactggacagtttattcatataaccagtgataatgatttttcaccaataatacgagaaacaagagtcatgaaaaaataattcatttattcattaatatttataattacagataaaaccaagagccagcatggcattgaaaaataaaatacggcttttttatccgcgctggttttgactcgatgaagaatagcggtggcgacaataataataagacaataaataaatataagtaatgatttatggtgaagtatatataacgatagaaacaataaaaaagcggacagaacgtttgaaatggttatcttttttgtaaatactaaaagactaaacattaaatagattaatgaaataatcgctggcattttctttccttgtaggcaagcgacccggaattcggtatccagcatgaagctggtggagggataaatacccctccaccatttaacgattactcgttatcagaaccgcccagacctgcgttcagcagctctgccaggcttgcagatgcatcttccgcagtgacctgcggtgttgctggctgctcgcccgcggcgcgacggcgcatacgatcctggtgatacgcataaccggtaccggccggaatcagacgacccacgataacgttctctttcaggccgcgcagttcgtcgcgtttacccgcaacggctgcttcggtcaggacacgcgtggtctcctggaacgatgcggcagagatgaacgactcggttgccagagacgctttggtaatacccagcagatcgcggaagaaggtagcccccactttgccgttcgcttccagctcgcggttagcgatcttgacgcgagagtattcaacctgttcgccttccaggaagtcggaactaccggcgctttcgatggtcgctttacgcagcatctgacgaacgataacttcgatgtgtttatcgttaatcttaacgccctgcagacggtatacatcctgaacttcgttaacaatataacgcgtcacagcatgaacgccacgcagacgcagaatgtcgtgcggcgcttccggaccatcggaaatcacatcaccacgttctacacgttccccttcgaacacgttgagctgacgccatttcggaatcatctcttcgtacgggtcactaccatcaaccggcgtaatcactaggcgacgtttgcctttggtttctttaccgaaggaaacgatacctgcgatttccgccagaatggccggctctttcggacgacgcgcttcgaacagatcggcaacgcgcggcagaccaccggtgatatccttggtaccgccggattcctgcggaatacgcgccagggtgtcaccagaactgatctgtacgccatcttccagctgtacaatcgctttacccggcaggaagtactgcgcaggcatatcggtacccgggatcagaacgtcattaccctgagcatcaacgattttcagcgccggacgcagatctttaccaccggtagtacgttcagccgaatccagaaccaccagcgaagacaaaccggtcagttcgtcggtctgacgcgtaatggtctgaccgtcgatcatgtcagtgaagcggatgaaaccactcacttcggtgataaccggcatggtgtgcgggtcccagtttgccacggtttcgccgccggcaacctgctcgccatcacctttcgccatgactgcgccataaggcactttatagctctctttggtacgaccgaattcgtcgatcagcttcagttcggtgttacgggaagtgataaccagtttaccgctggagttcacaaccgacttcacgttgctgagcttgatgctacctttgttcttaacctggatgctggattcagcagccgcacgcgatgccgcaccaccgatgtggaacgtacgcatcgtcagctgtgtacccggttcaccgatggactgtgccgcgataacgccgatagcttcacctttgttgatgatgtggccacgcgccaggtcacgaccatagcagtgcgcacatacaccaaaatcggtatcgcaggatacaacggaacgcactttaacggcgtcaacggagtttgcttccagcaggtcacaccactgttcgtgcagcagcgtgttgcgtggaaccagaatgtccgccgtacccggcttcagcacatcttccgccgtcacacgacccagaacgcggtcacgcagcggctctttcacgtcgccaccctcgataaccggggtcatcaggataccttcgtgcgtaccacagtcatcttcggtcaccaccagatcctgcgcgacgtcaaccagacgacgggtcagataaccggagttcgcggttttcagtgcggtatccgccagacctttacgcgcaccgtgcgtggagatgaagtactggagtacgttcagaccttcacggaagttcgcggtgattggcgtttcgatgatggagccatctggcttcgccatcagaccacgcatacctgccagctgacgaatctgtgccgcagaaccacgcgcaccggagtcggccatcatgtagatgctgttgaaggaaacctgctgctcttcctggccgtcacggttaatcacggtttcggtttgcaggttatccatcatcgctttggatacacgatcgttcgccgcagcccagatatcgataactttgttatagcgttcgccagcggttaccagaccagactggaactgctcctggatctcagcaacttcggcttccgcttcagagatgatctcgtgttttttctccgggatgaccatgtcatcaataccaacggacgcacctgaacgcgctgcataagcaaagccggtgtacatcgtctggtccgcaaaaataacggtcggtttcaggcccagaatacggtagcaagtgttcagcattttggagatcgctttcttgcccagcgcctggttgacgatggagaaaggcagacctttcggtacgatcatccacagaatggcgcgaccaacggtcgtgtctttcaggctggtgtgcgcaacgaattcgccgttttcatctttttcatattcagtgatacgcactttaacgcgcgcatgcagagaggccagacctgcgcgatagatacgctcagcttctttcgggccagtcagcaccatgccttcgcctttggcgttaacacagtcacgggtcatgtagtacaaacccaataccacgtcctgagacggaacgatgataggttcgccgttcgccggagacaggatgttgttggtagacatcatcagcgcacgcgcttcgagctgggcttccagcgtcagcggtacgtgaacagccatctggtcaccatcgaagtcggcgttatatgccgcacaaaccagcgggtgcagctggatagctttaccttcgatcagtaccggttcaaatgcctggatacccaaacggtgcagtgttggtgcacggttcagcagtaccgggtgttcgcggatcacttcgtccaggatatcccaaacgacagcttcttcgcgctcaaccattttcttcgcggctttgatagtggtggcgagtcctcgcagttccagtttgccgtagatgaacggtttgaacagctccagcgccattttcttcggcagaccgcactgatgcagacgcaggtatggacctacggtgattacagaacgaccggagtagtcaacacgcttaccgagcaggttctgacggaaacgaccctgcttacctttgatcatgtcggccaaagatttcagaggacgtttgttagaaccggtgatcgcacgaccgcgacgaccgttatccagcagggcgtcgaccgcttcctgcagcatacgtttttcgttgcgtacgatgatgtccggcgcagccagatccagcagacgtttcagacggttgttacggttgatcacgcgacgatacagatcgttcagatctgacgtggcgaaacgaccaccatccagcggaaccagcggacgcagatctggcggcagaaccggcagaacggtcaggatcatccactctggcttgttgccagactgtacgaaggcttccagcagtttgatacgcttggtcagctttttacgcttagtttcggagttggtttcgttcagctcttcgcgcagagtttcacactcttgctccagatccatgctcttcagcagggcctggatagcttccgcacccatcttcgcgtcgaattcgtcaccgaactcttccagcgcgtccagatactgctcttcagtcaggatctgttgacgttccaggttggtcataccgccttcgataaccacataagattcgaagtacagtacgcgttcgatatcacgcaacggcatatcgagcagcagaccgatacgggacggcagcgatttcaggaaccagatgtgagcagtcggagacgccagctcgatgtggcccatacgctcacggcgtactttggtctgggtcacttcaacgccgcacttctcacaaataacaccacggtgtttcaggcgcttgtacttaccgcacaggcactcgtagtcttttaccggcccaaagatacgggcgcagaaaaggccgtcacgctcaggtttgaacgtacggtagttgatggtttccggctttttaacttcaccgaaagaccatgaacggatcatgtctggcgaagccagagcaattttgatcgcatcaaactcttcggttttagtctgcgctttcagaaactttaataaatctttcacggatttgctcccgtcggagttagcacaatctggtgtcgggttttaccccgacaccagtgacctgtttgagcgagaattactcgtcttccagttcgatgttgatgcccagcgagcggatctctttcaacagaacgttgaaggattccggcatacccggttccatctgatggttgccgtccacgatgttcttatacatcttggtacgaccgttcacgtcatcagacttaacggtgagcatttcctgcagggtgtaggcggcgccgtaagcttccagcgcccacacttccatctccccgaagcgctgaccaccgaactgcgccttaccacccagcggctgctgagtaaccaggctgtaagaaccggtagaacgcgcatgcatcttgtcatcaaccaggtggttcagtttcagcatgtacatgtaaccgacggttaccggacgttcgaactgttcacccgtacggccatcgaacaaggtgatctgaccggaggtcggcaggtcgcccagtttcagcagctctttgatttccgcttctttcgcaccgtcgaacactggtgtggcaatcggcatacctttgcgcaggttttctgccagacgcagcacttcatcatcgctgaaggtgctcaggtcgactttctgacgaacgtcggcgcccagatcgtaggcacgctggatgaattcgcgcagtttcgcgacttcctgctgctgtttcagcatggcgttaatcttgtcgccaatacctttcgcagccatacccaggtgggtttccagaatctgaccgatgttcatacgagacggtacgcccagcgggttcagtacgatgtctaccggcgtgccgttttcatcgtaaggcatgtcttcgatcgggttgatcttagagataacacccttgttaccgtgacgacctgccatcttatcacccggctggatacggcgtttaacggccagatagaccttcacgatcttcagcacgcccggcgccagatcgtcgccctgggtgattttacggcgcttcgcttcaagttttttctcgaactcgtgtttcagttcgtcatactgctcagccagttgttccagctgattttgtttctcttcgtcggtcagaccgagttccagccagcggtcgcgcggcagtttgtcgagcttctcagcttcaacgccgccggacaccaacaccgcacggatacggctaaacaggcccgcttcgaggatctgcagttcttcagacaggtcttttttcgcctgcttgagctgcatctcttcgatttccagagcacgtttgtctttttctacgccatcgcgagtaaagacctgaacgtcgataaccgtaccggagacaccgttaggtacgcgcagagaagagtctttaacgtcagacgctttctcaccgaagatcgcacgcagcagtttctcttccggcgtcagctgggtttcacctttcggcgttaccttaccgaccagaatgtcgccgccagtcacttccgcgccgatgtaaacgataccggattcatccagtttggagagcgcagcttcacccacgttcgggatgtcagcggtgatctcttccggccccagcttggtgtcacgggacacgcacgccagttcctgaatgtggatggtggtgaaacggtcttcctggacaacacgctcggaaacgaggatggagtcttcgaagttgtagccgttccacggcatgaacgccacgcgcatgttctgaccgagcgccagttcaccgaggtcggtggacggaccgtctgccagcacgtcgccgcgttcaaccggctcgcccagagacacacatggcatctggttgatacaggtgttctggttagagcgggtgtatttggtcaggttatagatgtcgatacctgcttcacccgggtacatctcgtcttcgttaactttgataacgatacgggatgcatccacgtactgaacagtaccgccacgtttagctactgcagtaacaccggagtcgacggcgacagcacgttccataccggtacccaccagcggcttatcagcacgcagagtcggaaccgcctgacgttgcatgttcgcacccatcaatgcacggttggcgtcatcgtgttccaggaacgggatcagggacgcaccgacggagaccacctgctgggtggaaacgtccatgtagtcaacctggtcgcggctgaacaagctggattcgcctttgctacggcaggttaccagatcttctacaaagtggccttcgtcatccaggttggagttcgcctgagcgataacgtagttgccttcttcgatagcagacaggtaatgaatttcgtcagtaaccacgccatcaaccacacgacggtacggcgtctcaaggaagccatattcgttagtctgtgcgtacacggacagggagttgatcagaccgatgttcggaccttccggcgtttcgataggacatacgcgaccgtagtgcgtcgggtgtacgtctcgaacttcgaagcctgcgcgttcgcgggtcagaccgcctgggccgagtgcggagatacgacgtttgtgcgtaatctcagacagcgggttgttctggtccataaactgagacagctggctggaaccaaagaactctttcactgcggcggaaatcggcttggcgttgatcatatcctgaggcatcagggtatccagatcgcccagagacagacgctctttcaccgcacgctctacacgcaccaggccaacgcggaactggttttccgccatttcgccgacggaacggatacgacggttgccgaggtggtcgatatcatccacttcgcctttaccgttacggatatcgatgagcttcttcatgacatcaatgatgtcgtctttgctcaggataccggaaccttcgatttcgtcgcgcagcagagaacggttgaacttcatacgacccaccgcagacaggtcatagcggtcttcggagaagaacaggttctcaaacaggctttcagccgcttcgcgtgtcggcggctcaccagggcgcatcatgcggtagatttctaccagcgcgctcagacgatcgttagttggatcgacgcgtaccgtttcagaaatgtacgggccgtggtccagatcgttggtaaacagcgtttcgatacgcttgtggccggactggctcagcttagccagcagatccaggctcagctccatgttcgccgcgcagatcagctcgccagtagattcgtcaacgtagtctttagagacgactttacctgcgatgtactcaaccggaacttcgatatgcttgatatcgtctttttccagctgacggatatgacgcgcggtaatgcgacggcctttttcaacgtacaccttgccgttagcttcgatatcgaacgacgcggtttcgccgcgcagacgttctggaatcagctccatctgcagcttgttgtcgcgaatttcgaagacgactttctcaaagaacaggtcaaggatctgctcagtggtgtagttcagcgcacgcaggatgatggtcgcaggcagtttacggcgacggtcgatacgcacgaacaggttgtccttcggatcgaattcgaagtccagccaggaaccacggtaaggaatgatgcgcgcgttatacagcactttacccgaagagtgagttttacctttgtcggagtcaaagaagacgcccggactacggtgcagctgagaaacgataacacgctcagtaccgttgataacaaaggtaccgttgtcggtcatgagcggaatttcgcccatgtagacttcttgttctttaatgtctttaacggtgccttccggcgcttcgcgctcgtagatcaccagacgcagttttacgcgcagcggtgcggaataggtcacgccacggatctgacattcctgaacgtcaaacaccggttcgccaaggcggtagctgacgtactgcagctcggaattaccgctgtagctctgaatcgggaacacggaacggaaggctgcttccaggccgtactgcccttcaggatcttgctcgataaacttctgaaacgagtcaagctggatagaaaggagataaggtacatccagaacttgtggacgtttaccaaaatccttacgaatacgttttttctcggtataggagtaaaccatagggttcctcagctcgctgacaagtcgacccatctgtcctgcgggggacagtttgtgcaacactattttgttgaccggaaaatggatactttccgcaatgcctgttgctatcacgcttaaaccatttcattgcgatttacacagaacgtacgctctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagattttttcagtgcttcagcgtcatctttgctcacgccttctttcagagcggccggagcagattctaccaggtctttagcttctttcagacccaggccagttgcgccacgtactgctttgataacagcaactttgttagcgccagcagctttcagaattacgtcgaattcagttttttcttcagcagcttcagccgggccagcagctacagctacagcagcagcagcggaaacaccgaatttttcttccattgcagaaatcagttctacaacgtccattacggacatagcggatactgcttcaatgatttgatctttagtgatagacatttaaattgttcctgaatatcagaataagtttatacgtaagcaaatgcttgataaagacaactgcgattacgcagcttcttttgcatcgcgtacagcagccagtgtgcgaaccagtttgccagccgaagcttctttcatggttgccatcaggcgtgcaattgcttcttcgtaggtcggcagagttgccaggcggtcgatctgagacgccgggatcagctcaccttcaaaggctgcagctttgacctcaaattttgcattcgctttcgcgaactctttgaacagacgagcagcagcgcccgggtgttccatagagtatgcaatcagggtcggaccaacaaacgtgtctttcaggcactcgaactgagtaccttcaacgacgcggcgcagcagggtgttacgaacaacacgcatgtatacgccagcttcacgacctgctttacgcagttcagtcattttatctacagttacgccacgggaatccgcaactactgcagacagcgcgcctttggctacttcgctgacttcagcaacaatcgcttgtttgtcttgaagatttaaagccattagctttgctcctggatgtttgccggaactcatgttccggaactcacttcactcatctcaacgagaagagcgtcttaatacggtgagcagaaacaagccagagtatcaaaaataatcttagcgttctgtcaccgtctacgcaggggattaagcctcttgcgagacgcctgcggtcttcgacggaggcctggataggccaggctccaacgaacaaatcttttctatccgtcgctattcagcttgtgacggcgttggcttccttcgttcgcaccagtcacatagttatctatgctcctggcgactcactaagttgccgccttgtcacaacccgaatacctcggatatacgtctgcaactagcagaatacgtgggggtaagattgtagacaaaatcaccgcccacgtaaagactaatcttagttcgcagatgcgctcagaccagcctgatcaacggcaacgccagcacccatggtggtggagatgctaactttcttgatgtacacgcctttcgcctggctcggttttgcttttttcagcgcaaccagcagagcttccaggttttctttcagtttgtcagcgtcaaagtccactttaccgatggtggtgtggatgatgccgtttttgtcgttacggtaacgaacctgacctgctttagcgttcttaaccgcttcagcaacgttcggcgttacggtaccgactttcgggtttggcatcaggccgcgcggacccagaacctggcccagctggccaacaacgcgcattgcatccggggatgcgataacaacgtcgaagttcatttcgcctttcttgatctggtcagccagatcttccatacctaccagctcagcgccagcagctttagctgcttcagcgttcgggccctgggtaaatacggcaacgcgaacagaacggccagtaccgtgcggcagtacagtcgcgccacgaacgttctggtcagatttacgagcgtcgatgccgaggttaacggcaacgtcaacgctttcgttgaatttagcagtggccagctctttcaacagggcaatagcttcgttgatgtcgtactgtttggtcgcatcaactttttcacggatcacgcgcatacgcttggtcagtttagccatttcttagtcctccactaccaggcccatggaacgtgcagtaccttcgatggagcgagtcatcgcttcaatgtcggcaccggtcatgtcggcagctttggtctgcgcgatttcctgcagctgagcgcgggaaattttacctactttgtctttgttcggcttgccggaaccagacttgataccagccgcttttttcagcagaacagctgccggaggcgttttggtaacgaaggtgaaagaacggtcagcgtaaacggtaataacaaccggaatcggcagacctttttcgatggaatccgtttttgcgttgaacgctttgcagaattccatgatgttcacaccctgctgacccagtgctggaccaaccggcggactcgggttcgccataccagctgcaacctgcagcttgacataggcttgtactttcttagccattctaaattcctcgaattgggtagtatcgcttcaaagaagctccccgtgataaatatcgctttatgggcataaggcccataaaaacaaaaggcgcgaaattgtatgtcaattttgcgccctatgcaacgattagatcgctgcttttttgatcgcagccttacgctttctcaacctgactgaagtccagctctaccggggtcgcacgaccgaagatagaaacagacactttcaggcgagacttctcataatcgacttcttcgacaacgccgttaaagtctgcgaacggaccgtcgttaacacgaaccatttcacccggttcaaacaacgttttcggccgcggcttatcgccaacctgctgcaggcggttcatgatcgcatcgacttctttgtcgctgatcggcgccggacggtcagaggtaccgccgataaagcccatcacacgcggcacgctgcgcaccaggtgccagcttgcgtcgttcatgaccatctggaccagaacgtaacccgggaagaatttgcgttcgcttttgcgacgctggccgccacggatctcaacgacttcttcagtcggcaccatgacttcgccaaacagctcttccatattgtgtaatttgatatgctcgcgcagcgatgtggctacgcggccttcaaaaccggaaaacgcctgaacgacgtaccagcgctttttaggtgcttcagacatctcagaacctcaggccagtgataaaggataccaggcgaaccagaataccatccagtccccacaggatcagtgacataactgcggtaaccgcagcgacgatcagcgtggtgtgcagcgtttcctggcgagtcggccaaatgaccttacggacttcggttctcgcttcacgggcaaaagcaacggttgctttaccttttgtcgtcaacagcgcgacaccacccgctgcaacaatcagaattactacggccagcgcacgcagcggcagcatcatgtcgcgatagaggtagttgccgacgattgcgacgatcagcaatatggcaacaactatccacttcatcgcttccaggccgcgcccgctcccttgagcttcggtattcgcactcataaaccaacctgtcagaagtattctacaaacattttcaccccgcaatcgcgaggcaaaccaaatcgaaacgcttattcgcctttcggattatacgccctctacagagcctgtctcagcaatgattatgacaaataaaatcactgatgagccaggttctggtgtgaaagcgtgcaaaaagggcatcaaatgatgcccttttattgcgcattgcgtcaaatgttatcagcgattagccgagaactttagcaacaacgcccgcgccaacagtacggccgccttcacggattgcgaaacgcagaccgtcgtccattgcgatcgggtggatcagggtaacaaccattttgatattgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttagtgtgcggcttgatggtgcccggcttagccagtacctgaccacgttcgatttcttcacgtttgataccacgcagcagaacacctacgttctcaccggcacggccttcgtccagcagtttgcggaacatttcaacgccagtacaggtagacttctgagtctctttgataccaacgatttcaacttcttcgcccactttgatgataccgcgttctacacgaccggtaacaacggtaccacgaccggagatggagaatacgtcttcgatcggcagcaggaacggcttgtcaatcgcacgctctggttccgggatgtaagaatccaggaagccagccagttcgatgattttcgcttcccactctgcgtcgccttccagcgctttcagagcagaaccacgaacgatcggcgtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgggtctgcggcatcgggccgtcagtcgcagcaacaaccaggatcgcgccgtccatctgagcagcaccggtgatcatgtttttaacatagtcggcgtgccccgggcagtctacgtgtgcgtagtggcgggtcggggtatcgtattcaacgtgagaagtgttgatggtgataccacgcgctttttcttccggcgcgttatcgatctggtcgaatgcgcgggcggcaccgccgtaggttttagccagtacggtagtaatggcagcggtcagcgttgttttaccatggtcaacgtggccgatagtaccgacgttaacgtgcggttttgtacgttcaaacttttctttagacatcgattgtccctctaagacacggataaatcggtgatatcaccacatcaaccaggcaacacgcccgacttgttgaatgctaataaacagaagagaaaaacaggaaggagaaaagaagtggtgctgataggcagattcgaactgccgacctcacccttaccaagggtgcgctctaccaactgagccatatcagcacatcttggagcgggcagcgggaatcgaacccgcatcatcagcttggaaggctgaggtaatagccattatacgatgcccgcatcctggaactcggctacctgattttcattctgcactgaatatcgagagaaactctctttattcgagccggtaagcgaacttatcgtctcgggctgcgccatcgcgcggccgaaaatggtggtgggggaaggattcgaaccttcgaagtctgtgacggcagatttacagtctgctccctttggccgctcgggaaccccaccggacttgatggtgccgactaccggaatcgaactggtgacctactgattacaagtcagttgctctacctactgagctaagtcggcatcaagtagcgcgcattctatggagacctgcgtgctcatgcaactaaaaaattgcataaaatgttctatcgctcacattttgcgctataagagacaaaaatgctctaatttcaaacaagagagcataaattttcggcattttaccaaccgtctgaccaggatacgacgcggcatttcaacgctccgtcgatagaaagcaatcttctgtatctggtatattcgtcacattgcttctcagggatagctttcacagcgagattttttcttattattcctccccatctggtgttaccctcctgcccattgtccaaattaacttaaatgtgacgtgccgttgcatgtcagggatggccctcgttcatcgctgaactgatgtagcaatagcagccagaaacatgcttatgagtataaaagagcaatcgttaatgacgccttacctacagtttgatcgcagccagtgggctgcgcttcgcgattctgtgccgatgaccctgaccgaggatgagatcgcgcagttaaaaggcattaatgaagatttatcgctggaagaagttgcagaaatatatttacctctctcccgtttgctaaatttctatatcagttcaaatctgcgtcgtcaggctgtcctggaacagtttctgggcactaacggccagcgaatcccttacatcatcagtatcgcgggcagcgtcgcagtgggtaaaagcacgacagcacgcgttctgcaagcgttgctgagtcgctggccggaacaccgccgtgttgaattgattaccacagacggcttcctccacccaaaccaggtgttgaaagaacgcgggttaatgaagaaaaaggggttccccgaatcgtatgatatgcaccgactggtgaaattcgtttctgacctcaagtcgggcgtaccgaacgtgacggcgccagtctattctcatttgatttacgatgttattcctgaaggggataaaaccgtcgctcagcctgatatattgattcttgaaggtttgaatgttttacaaagcggtatggattatcctcacgatccgcaccatgtatttgtctctgatttcgttgatttctctatttacgttgatgcgccagaagaacttcttcagacgtggtatatcaatcgcttcctgaaattccgcgaaggggcgtttaccgatcctgactcttatttccacaattatgcgaaattatctaaagaagaagctgttaatacagcagcttcgctttggaaagaaattaactggttgaatttaaaacaaaatatcttacctacgcgagaacgtgccagccttattatgaccaagagcgctaaccatgcggtggaacaggtaagattgcggaaataacagaaaaaaggggagtaccgactccccttttttactattcggcgcttcgcagcgatatttctccgcccatccagggtttaatcacgccatcctgttcaagcaataatgcgccctgagtatcaatgccgcgggaaataccaaatatttctttgtcgccaataattagttttaccggacgatcaataaaattatccagttttttccagcgcgaaagataaggagaaagaccttcttgctcaaaaagctcaagcgcagcacgtagcttataaatcagctttgcggccagcatattgcggtcgagcgtaattccggcctcttgtagtgtgatccatccctgatttatcacgtcctcttctacacgacgcattgccatgttaataccagcgccaatcactatttgtgcggcatcgcccgttttaccggttaactcgaccagaatacccgccagtttgcgatccagtaggtaaaggtcgttaggccacttcacacgaactttatctgcgcccagttcacgcagcacttccgccatcacaattccaatgaccagactcaagcctattgccgccgcaggcccctgctccagacgccagtacattgaaagatatagattcgcaccaaacggtgagaaccatttacgcccgcgacgaccacgccccgcctgttggtattctgctacacaggcatcgcctgaacgcagctcgccaattcgatcaagtaaatactgattggttgaatcgataacgggcaataccgccacgtttccgctatccagttggctatgtatacggtcagcatccagtaactggatgggttccggtaagctatatcctttcccgggaacggtaaatacatctactccccagtcgcgtaatgtctggatatgtttattaatagccgcacggctcattcccagccgttcacccaactgctcgcctgagtgaaactctccgtcggcaagtagtgagatcagcgtcaggggaacggtagtatctttcatgcaatgctctccacagcgttcacctctccgaactgaccaataaagcgaacctcaggctccagccagacattaaatttttcacccactttttgccggacatgatgcgccagcgccaccacatctttacttgtcgcatcattcgcattaatcaataccagcgcctgttggcgatgcaccgcagcgccgccaatggtgacgcctttcaactgacattgatctatcagccagcctgccgccagcttcactgagccgtctgcctgagggtaatgcggcgcgttgggaaatcgttctaacagttccatagcgatatcggctgcgacaacgggatttttaaaaaagctgcccgcattgccattcactttaggatccggcaattttgtggtgcgcatatggcatacagcatcaaacacctgttgcgcggtgaccgttttcgggtccagacgagtaagatcgccataggtcaacaccggctgccattgctttgacaaacgcagacccaccgcgacgatcgcaacgcgatcctgatattcatttttgaagatactgtcacgatagccgaaacggcattccgccgcggacaaacgcagacgttttcccgtttccagttcaacgcagtcaacgtagtcgcagacgcgatgtagttctacgccatacgcgccaatattctgtataggcgaggaaccaacgcagccagggatgagcgccagattctccaggccgggcatgttgttgtccagcgcatagcgaaccagctgatgccagttttcgcctgcgccgacgtgtaggtgccaggcgtccgcggtttcattcacctcaatgcctttcaggcggttaaggatcacggtgccggcgtaattttccagaaacaggacgttgcttccttcacccaggatcataaccggcagtccctcacgagttgcttgctgccaggcgctcagtagttgttgttcgttttcagcgcatacgatgtgctttgcacaatgatcaatgccgaaggtattccagggttttaaggaatgggtcatggctgctttcctgatactcaatcggcaatagtttaccgtatctgggttgggaaggcttgcggttatgtcgacggaataaggcggtgtacacaggcattgtgccgaacttgccgtaggccggataaggcggagccgccatccggcggtgcaggttgcctgatggcgctgcgcttatcaggcctacatttttacagttaccacacatgcaaaaaagcccatccgtcaggatgggcttcttcactaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacttaaaggctcagggagaactcatctcggggcaagtttcgtgcttagatgctttcagcacttatctcttccgcatttaggctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaaacttcgcagtgaaccctttcaggtacactctgaagtattttttcgtaaacactcacgagatggtggagctatgcgggatcgaaccgcagacctcctgcgtgcaaagcaggcgctctcccagctgagctatagccccatcgtgtagtcagaacctctttaccgataatttttcctgagacaaggcgtggaataacgaagcatacatcagtatgtgagttatttcacaacgcagtattcagggaaaatctggtaggcctgagtggacttgaaccaccgacctcacccttatcaggggtgcgctctaaccacctgagctacaagcctgtagaggttttactgctcgtttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcagtgccgcttcgctttttctcagcagcgcggggtgtgcatattacgctttcccgcttcagagtcaagcgtttattttcgcttttctccgtgggattctggtctgaaccccgctgacccggcggcctgtgtgccgttgttccgtgtcagtggtggcgcattatagggagttatttctgcctgacaagaggaaatttaaaataatttctcaagtgcctggtatttacccaaaacgccattaaaccgccagtttttcgagcgtttcaaagccataacgctgtaaaacgggtaataattgttcagctcctggcgtcattgccatgcaataagcaatattggcatcggttgatttcgcatccggcgcttcatgttccaacagccaggctgtacgacgcgctatcgccgcgccggaatccactaaccgcgtcccttcgggcaggacttgcaaaagctcgtcccgtaatagagggaaatgcgtacaccccagaacgaccgtgtcaggcggctccggcattcgtagccatgggcgtaatatacggcgcagttcttccagcgataccgaatcgccatgtaatttagcttccgccagttccaccagttctgccgaccccaacatcgctatctgacattcattggcgaagcgcgcaatcagctcgtgagtataaggacgtttgaccgtggctctcgtcgccagtagcccgacgacgccattggcggtaagccgcgccgctggtttaatcgcaggcacaacgcccaccaccgggaaggcaaacttttcacgtaatgcgggaagtgagaccgtactggcggtattacaggcaatcaccgccagtgaaaggggatagcgctgctgtaccgcagtcacaatctcgacaacgcgctcaacgataaacgtttcgctcttttccccgtaggggaaagccacgttatcgaaagcatatatatagtggagatccggcaggagccgccgaatctcatcatagaccgacaatccaccgacgccggaatcaaataccagcacggtgggacgtggttcagaaggtgtagctgccagacaaggtgtattctcgtcctgcagtttggtagccataaactgtctcgtaatctttgtcgaacaggttggctattttaccacgaactgtcagatgtgaggtgaccggatatgcaaccgtaagatcccataaactgacgccgcccatttttactgtccggtatgggtaagcggagtaatccgaatcatagcgggaaccaaggtattgatatgtcaccccccagtcaaaatcgtaaacgtcccagtcaagttgatattttgccatctgtttggaacgccggggtaatggcgtatcggtaatcgcattacgcgcatcaacgtaatcataactgaccgtatgcgttaacggtccggtatcgaaattcgccgtcgcctcaatacctttaatacgcgccttaccttcgttgtaatatttttgcagatgatcgtcataatcgatcatgtcattaatatcgttacgataacctgaaatacgccagctgacgccagcggtgagcccttcaaatgcgccttcccactgtttactcttttcaggattcaggttcggattaccgtaatacccatacagctggcccaaattaggcgctttgtaggaggttccgtaggaggcaataaagcgataaccttctataaactcccatcccgcgctggtttgccatgtaccgtgacgaccaaactgggagttgtcatcactgcgcgccgccgcttccagggtgaagtcacccaactgttgtaatcctgtcaggtaaaccccggtattacgctggtcatatccctcgggcacatagccggtacctggcgtggtagtctgtttctgccagtctacgcccgccccaacattaccgtgccccacaaccacactgttggtccattgaacattgtactgtttcatctcatccagcgtggcggaggtatcataccgaccatagtgcggatcatagttgtaatctttactgtggctatagcttgaaactagctgagactgaatacgttcgccattaaagcgcagcccggcgtcccagctttggctataaagtttgcgtgtatcaatcagcggcgagcccggcgagtaataggcgtcgtaatcggtacggttatcgtagccataaccacgcacgaatccgctccagcgatcagaaaaggtatgctctaacgcgccataaagcgttttactcaaaaagccgtcccggtcaggctgcgcctgcatcccggtaccgcctttcgctaccacgtcaaaccctttggtgtattcgtaatcgccgatcaacgtcgcccgcgtgttttcgccaagttgctgttgcgtcgagaggtcgtaattctggtagctattgcttccccatccagcggttaattctgtgcctgggttatcgcgcgtcgtaatgatattcactacgccgccgatagcatcggaaccataaatagcggaacgcggaccgcgaatatattcaatgcgctgtaccagcgacaccgggaactggctgagatcggcggacccgctcacgcctgctaaattcagacgcacgccgtcaatcaataccagtacatggctggagttggtgccgcgaatgaaaatggaggagttttgtccggtgccgccgctctgcgcaatatcgacgccaggcaaacggcgtagaacatcatttacggaggtcgattgccagcgttcaatatcctgacgcgtcacgatggtaacgggcgccagaaccgcgctgcgcggctgctgaaaacggttggcggtgacaaccagtgtatccgggctagtgtcctgcgcccaagctgaaaaggccgtgacggagaacgccgtcagcagcgtagcttttttaatcattgtaaagcatccacaatataagaaggatgccgcaggcttcatcgatagtacgcgatgatgaaaaaccagatgcgacgttagccggcaggtcttcgggcttggagggttatccgttgactggatagcagaaatgatgacttcccgccggaggcagtgtctgcttacgctctcatctcacctttccttaccgctgcgcgtcagctccagattttcactggattccctattaactcacaggaccggcccacggatgctaccgtctgtcacaacaccctgtccagaccgcgcatcacaaatcagaaatcatcaatagctggacatccactgagcaatccctacaatccccgcgtacttttattattcaggatgcgatatgacccccgaacatcttccgacagaacagtatgaggcgcagctggccgaaaaagtggcgcgcttgcagagtatgatggcgccgttttctggcctggttccggaagtatttcgctcgccggtcagtcactatcgtatgcgtgcggaatttcgcctgtggcatgacggcgataacctgtaccacattatgtttgatcagcagaccaaaagccggattcgcgttgacaccttcccggcggccagccaactgattaataccttaatgaaggcgatgattgccggcgtgcgcgataatcatgcactgcggcataagctgttccagatcgattatctcacgaccttgagcaaccaggcggtagtgtcgttgctgtaccataagaagctggacgaagagtggcgtgaagccgccactgcgttacgcgatgctttacgcgcgcaaggtctgaacgtacacctgattggccgggctactaaaaccaagatcgaattggatcaggattatattgatgagcgtctgcctgtggcaggtaaagagatcatctaccgccaggtcgaaaacagctttacgcagccaaacgccgccatgaatattcagatgttagagtgggcgctggaggtgacgaaagactcaaaaggcgatctgcttgagttgtattgcggcaacggcaatttttctttagcgctggcgcgcaattttaaccgcgtgctggcaaccgaaatcgccaaaccgtccgtcgctgccgcacagtacaatattgccgctaatcatattgataatgtgcaaattattcgcatggcggcggaagagtttacccaggcgatgaacggcgttcgtgagtttaaccgcctgcaggggatcgacctgaagcgctatcagtgcgaaaccatttttgtcgatccgccgcgcagcggtctggacagcgaaacagaaaaaatggtgcaggcttatccacgtattctgtacatttcctgcaatccggaaacgttgtgcaaaaacctggaaacgttaagccagacgcacacggtgtctcgcctggcgctattcgatcagttcccgtatacgcatcatatggaatgcggggtattactcaccgcaaggtaaaatgtacgtcggatggccggttataccgccatccggcattcgcacactactccgcggtgtcctgcttgcggttacgcagcttaaagccaatccagaataccagaatcaccgacagcaccgccgggaagaaattagagccgatatccggatattctgcacgcacgacagtgctatacagtaaaacgccaagaatgaaacaagcggcggccaaccccggcaaacctaccggcatagtacgattttggtagcgctgatgcaggcaatataccgtcagtaccagcgagataaccgggaatacggagaacggcacaatagcgctaaacaacgccgcgaatgtgccgttaatcgataagccagcgatgagcgccagcaacagcgtacctttatcttgacctgactgtttcattactcgtccttcacgttattcggaatgatgtgctattttctcttgctcacggcgataccagtaatacgcccctttcgcaatcatgcgcagttgcaataccagccgctcttctaattgccgacgctgttcagcgccgatgtccaacgcctctgcgcccgcgctaaagacaatagtcaccatcgcttcggcctgggcttcagtaaacgcgcgcggcatatggttttcgagttccagatagtcggcaagttccgcaataaaatgctgaatctcccgcgcgacggcggcacgaaacgccgcggaagtgccggaacgctcgcgcaacaacagacggaaggcgttgggattgttgccgataaactccataaatgtagagaccgacgtgcgaatgacgctgccgcctttcgcgatacgctgtcgcgcctgacgcatcaactgacgcagcatcagaccgctttcatccaccatcgttagaccgagttcatcgacatcgcgaaaatgacggtaaaacgacgttggcgcaatgcccgcttcacgcgccacctcacgcaaactcaggctggcgaaacttcgctcagcgctcagttggctgaatgcggcttccaccagcgaacgccgggttttttctttttgttgcgctctaacacccatcacaatgtctgaatccttccatatgccttattcggcactataccagagaataaaagtaacgggttcacactggattgtgaatgattgtttacagacagtttgtgctccggcttcgcaaaaaagcacaacgataattgggttaaagctgggcaaatgttatcatcgtgtttattttatgtataaaaacaggtgagtaataccatgccacattcctgggattatgatgcagtcgtcatagggtcaggccccggcggtgaaggcgctgcaatgggtctggttaagcaaggagcacgcgtcgcggtgattgagcgttatcataacgttggcggcggatgtacccactggggcaccattccatccaaagcccttcgccacgccgtcagccgcattattgaatttaatcaaaacccgctctatagcgaccactcccgtctccttcgttcttctttcgccgatatccttaatcatgccgataacgtgattaatcaacaaacgcgtatgcgtcaggggttttatgagcgtaaccactgtgaaatcttgcagggcaacgcccattttattgacgaacataccctggcgctggaatgccatgacggcacggttgaaaccctgacggcagaaaaatttgttattgcctgtggttcgcgtccttaccatcccaatgatgtggatttctcgcatccgcgcatttatgacagcgactcaatcctgagtctccaccatgaaccgcgccacgttattatttacggcgcaggcgttatcggctgcgaatatgcgtccatattccgcggtatggatgtgaaagtggatctgatcaacacccgcgatcgcctgctggcctttctcgatcaggagatgtccgactctctctcttaccatttctggaatagcggcgtggttattcgccacaatgaagagtatgagaaaatcgaaggctgcgatgatggcgtcatcatgcacctgaaatccggcaaaaaactgaaggctgactgcctgctctatgctaatggccgtaccggtaacaccgattcgctggcgctggagaatattggtctggaaacagacagccgtggacagctcaaagtcaacagtatgtaccagaccgccctgccgcacgtctatgcggtgggcgacgtgattggctatcccagtctggcctccgccgcctacgatcaggggcgtattgcagcgcaggcgctggtgaaaggcgaagcgaccgcgcatcttatcgaagatatccccaccgggatttataccattccggaaatcagttctgtcggcaaaaccgagcagcagttaacggcaatgaaagtgccttacgaagtgggccgcgcgcagtttaagcatctggcgcgagcgcaaatcgtcggcatgaacgtcggcacgctaaaaattctctttcaccgcgaaaccaaagaaattctggggattcactgctttggcgaacgcgccgccgaaattattcatatcggccaggcgatcatggagcagaaaggtggcggtaacaccatcgaatacttcgttaacaccacctttaactacccaaccatggcggaagcttatcgggttgcggcgttgaacggcttaaaccgcctgttttaacgccttgtcgaaatgtccatccattgcgccacggatggcctctgccagttgctcataacggctacgcagcggcgatcccgggcgataaaccagccccacggtacgacgcggctccggcttaatgcatggcagataaaccacgccgtcgcgcttacgctcctgcggtacggccagcgcggggagtagtgtaataccactgcccgccgccaccatgttgcgcagcgtttccagactggtcgcccggaaatgggtatcttcatccgctcccgcttcaaaacagaaccccatcgcctgatcgcgcagacagtggccatcttccagcatcagcaatttctcgcccgccagatcggacatcggcacgcgatcgcgattcgcccacggatgatcttcataaatagccagcatcatgggctcatcaaacagcggcacttcgataaacgcctcgctctctttcaccagcgccagaatagcgcagtcaagcttgccgctatcgagttgcgctaacagctggtgcgtttgcgcctcatgcagatacatttccagcttcgggaaagtctggtgcaacattggaatgataagcggcagcaaatagggaccaattgttgggattaaaccaatatgcagcgggccggacatcgtctcgccttgttggcttgccatctccttgagcaccttgacctcacgcagtacggtacgcgcctgatccaccagcagtaagcccgcctgggtaaacagcaccttacggctcgtacgctccagcagcataacgcccagctcatcttccagcttacgtatttgcccactaagggttggctggctgacgtgacaggagtccgccgctcgccggaaatggcgatgttcggctaacgccaccagatattcaagatcacgaatattcattattcatcctccgtcgccacgatagttcatggcgataggtagcatagcaacgaacgattatccctatcaacctttctgattaataatacatcacagaacggagcggtttctcgtttaacccttgaagacaccgcccgttcagagggtatctctcgaacccgaaataactaaagccaacgtgaacttttgcaaacctctggtccgcttttttttgcgtaaaaaagcccggcgtcgctgatgctcggccgggcagtattacctgatggcgctacgcttataaggcctacaacgcgaggcgcaccttcgcatcgtcgatggcctgcgccacctgctgcggagaaacgccgccttttgccgcccgtttatccagacacgactgcaaagacaatatcggatacacatcgtcgccaatcacgcggctgaatttctgtaaatcggccagcggcaacgcttccagcggcttaccctggcgaatagcttctaccacagcttcgccgacaatatggtgcgcttcgcggaacggcacgcctttcgcgaccaggtaatccgccagctcggtggcgttggcatacccctgttgcgccgcgtcctgacaacgtgggcgtttcacctgaataccgtccagcaccaacgccgccatatgcaggcagtcaagccagatatcgagcgcatcgaacagcccttctttgtcttcctgcatatctttgttatacgccagcggcagaccttttaaagtcatcatcatgccggttagcgccccttgtacgcgaccgcacttaccgcgaatcagctccagcgcgtccgggtttttcttctgcggcattaacgatgaaccggaagtcacgcggtcagaaagctctacaaagcccgcttcaccagaattaaagaaaatcagatcttccgcgaaacgtgacagatgcaccatgccgatagccgcatcagaaagcagttccagtacgtggtcacgatcggacacgctgtccaggctgttgcgggtcgcagacgtgaagcccagccagcctgccaattgttcacggtcaatttcataggccgttcccgccaacgcgccgcagcctagcggactcacgtccagacgtttaagcgtgtcctgcaggcggctttcatcgcgcgccagcatttcgacatacgcgagacaccagtgggcgaaagtcactggctgcgcgcgttgcagatgggtatatcccggcattaccgcgtcctggttcgcctgcgcggtttccaccagcgcgctctgtagctggcggttagcggtgagcagttccatcaccgtctctttgcaccacagtttcaggtccgtcgccacctgatcgttacggctgcgcccggtgtgcagctttttacccaactgacccactttgtcgatgagcttaccttccacccagctatggatatcttccgcatcgctttgcaggatttgctgcggattcgcgcgaacctcttccagcagcacgttcagcgcttcttccaactgtcgttgctcatcggcagtcagtacgcctaccgtgaccaatgctttggaccaggccacagaaccgacaatatcctgctccgccagacggtaatcgaagcgcaacgaatcattgaattgtttaaaccgttggtctgccgcctgtgtaaaacgcccaccccaaagtgccataatagacttccttaaattcttcgaatttcactgccggatagcgctacgcttatccggcttacaatttctgttcacgtaggcccgataaggcgcagccgccatcgggcgaacaaatagttaagccagaatacgcgtgccaatcggcgtgccgttaaacagcgccggcaattgttccgcatgacgccaggaagcaatatccaccggacgacccagcgcccgcgcagcatcgagagccgcattcactttcacaatcatcccgtcggtaataatgccctggtcgataagctgttcggctttggacgccgtcatttcggcgatacgctggcctttgccgtccagaataccgctcacgtcagaaagcaggatcagatcggcccccagcgtcgccgccagcgcggttgccgcctgatcggcgttgacgttcatcagttggccgtcgtctgttacgccaatggagctgaccaccggcagaaagccgttttccagcaacatgttaatcagcttcggcgaccccggttgcgccagcccgacgtggcctaacgcttcatcgagttgggtcacgtttacgctgtcgccatcgcccagaaacagaccaacagaggcgatatggtgtttcttcgcccaagccagcagagttttgttagcggttcccgccagcgcaccggtaatgatgccaatctgatcggcaggcgtcacgcgcaggccgtctttctttttcactggcaaattaagccctttcatcagctcatccaccacgcaaccgccgccgtgaacaatcaccagcggacgctgatgggactcacgatagttgaccagcgcggtaaaaagacgttccagagcctcttcgctatccagtaatacgccacccagcttgataattaatggattcatcatttcacccttaaataagagactgcgtttcagcgaagccaaaacgaatattagcgcactgcaccgcctgcgccgctgcgcctttcaacaagttgtcttcggttgccaccacaatcagatgttcgccctggacggcaaaaccaatatcgcagaacggcagcccgacgacgttctttaacgccggaacgcctttgtcatacaggcgcaccagcggtttgtcgccataggctttttgcaacacgtcggcgacctgcgcatgggttactcccgctttcaggcggcaggtaatggtttccagaatcccgcgcgggaaattccccagatgcggggtgaagatgacctccgcgcccagatgggcagcgatttccggctgatgacgatgcgtaaacacaccatacggttgcaaactcacttcacagaaactgttcgatattgccgccttgcgccccgcgccgctcaccccgctggtggcattaattaccggccactgcgtcagatcgagaagcccgccgtcaatcagcggttttagcgacaactgcgctgcggttggatagcaaccaggaaccgcaatcagattcgccgtgttcagtttatcggcattccactccgccagaccgtacaccgcctgctccagcagctcaggatactgatgagtaaatccgtaatacttttcatagaaggcgcgatcgtttacccgaaacgcgccggaaagatcgaatacgacgcatccggcctgtaaaaactgcggcgccagatcgtggctcacttcatgcgctgtcgccaggaacaccacatcaacatctgcgctaaagtcacgtacatccgacatcggttgcaatggcaggtcaacaatcccttttaactgcggatgtaaatcagaaattaactttcctgcatcattgctttgcgctgagacggtcaaagcggttatggtcatatgtgggtggcgatttacgtagcttacaagctctgcgcccgcataaccgctagcgcctacaatcagcgtattcaacatcgggttcctttatgctcaacgttaatgtatttttattcataattaatgcatgaatattgatactatcatgacctgaggtgtgtcaacaatgaaaaacgttttaccgccatttatcgagatttaccgcgctctgattgccacaccgtcgataagcgcaaccgaagaatccctggatcaaagtaatgcgtctttaatcactttgcttgcaggctggttcagcgatcttggtttcaacgtagaggttcaaccggttccaggaacgcgaaacaaatttaatatgctcgccagcaccggacatggcgcgggcggtttgctgctgaccggccataccgacacagttccctttgatgacggacgctggacgcgcgacccgttcacgctgaccgagcacgacaataagctctatggtctgggcactgcggatatgaaaggcttcttcgcttttattctggacgcgctacgtgacgttgacgtcacaaagttgaaaaagccgctctacattctggcgaccgccgatgaagagaccagcatggcgggggcgcgttatttttccgaaaccacggcattacgtccggactgcgcgatcattggcgaaccgacgtcgttgcaaccgatacgcgcgcacaaagggcatatctctaatgtcgttcgcgtcctggggcagtccggtcattccagcgacccggcgcgtggggttaacgccattgaactgatgcacgatgcgattggccatatcatgcaactgcgtgactcgctgaaagcgcggtatcactacgaggcatttaccgttccgtatccaacgctgaatctgggccatatccacggcggcgatgcctcaaaccgtatctgcgcctgctgcgaattgcatatggatattcgtccactgccgggcatgacgttaaacgaccttaatggactgcttaacgacgcgctggctccggtaagcgaacgctggccgggccgcctgacggtggcggaattacatccgccgattccaggttacgagtgtccaccggaccaccaactggttgaagtagtagaaaaactgttgggaacaaaaaccgacgtggtgaactactgtactgaagcgccgtttatgcagacattatgcccaacgctggtgcttggtccgggctcaattaatcaggcgcatcaaccggatgaatatctcgaaacgcgttttattaagccaacccgggaattgattacccaggtagtacaccatttttgctggcattaatgcatattgcccggtgacacgatgtttaccgggcctcccccgtcttgtaggccgcataagcgcagcgccatccggcatctctacgccacatgttcataagcatttcttatttggcacgatgcgaattaactttaataaattaccgccattttttcgtttgctgaaccgatttcgcagtaattgacgccacgggttttacgtggctttataaaagacggctaaaaagcaaagtcagaaaaatttcacgtcacagcaaggcggcaaacgagcccattccgcagaactagcatacgggcgagcgcagccactgccgctgtggcatgaaagagacagggcaattacattaaagatggggtgtctgatggcatatgaacgaacaatattccgcgttgcgtagtaatgtcagtatgctcggcaaggtgctgggagaaaccatcaaggatgcgctgggagagcacattcttgatcgcgtagaaacaatccgtaagctatccaaatcttcacgcgccggcaatgaagctaatcgccaggagctgctcaccacgctacaaaatttgtctaatgacgagctgctgccagttgcgcgcgcgtttagtcagttcctgaacctggccaatactgccgagcaataccacagcatttcgccaaaaggcgaagccgccagcaacccggaagtgattgcccacactctgcgtaaactgaaaaaccaaccggacctcaacgacgcaaccatcaaaaaagcggtagagtcgctgtctttggagttggtgctaaccgcccacccgacagaaattacccgccgtacgcttattcacaagatgggggaaatcaataactgtctgaaacagcttgataataccgatatcgccgactacgaacgccaccaggtgatgcgtcgcctgcgccagttgattgcccaatcctggcatacggatgagatccgcaagcagcgcccaagcccggtggatgaagccaaatggggcttcgccgtggttgagaacagcctgtggcagggcgtacctaactatctgcgtgaactgaatgaacaactggaagaaaatctcggctacaaattgccggtggattttgtgccggtacgttttacctcctggatgggcggcgaccgagacggcaacccgaacgtgacggcggagatcacccgccacgtactcttgttaagccgctggaaagccaccgatctgttcctgaaagacattcatgtcctggtatcagaactgtcgatggtcgacgccacgccggagctgctggcgttagtgggcgaagaaggcgcgtctgagccgtatcgctacctgatgaaaaaattgcgcgcccgtctgatggcgacccagtcctggctggaagcgcgtctgaaaggcgagaagctgcccaaaccggctggcctgctgacgcaaaacgagcagctctgggaacctctgtacgcctgctaccagtcgttacaggcctgtggcatgggcattatcgccaacggcgagttactcgacacgctccgccgcgtgaagtgtttcggcgtaccgctggtgcgtattgatatccgtcaggagagcacccgccataccgaagcgctgggcgaaattacccgctacctcggtattggcgactacgaaagctggtcggaagccgacaagcaggccttcctgatccgcgagctgaactccaaacgtccgctgctgccgcgtaactgggagccgagcaacgatacccgcgaagtgcttgaaacctgcaaggttattgccgaaacgccaaaagggtcgatcgccgcctacgtgatttctatggcgaaaacgccgtctgatgtgctggctgtgcatttgctgctgaaagaggcaggtatcggctttgccatgccggtcgcaccgctgtttgaaaccctcgacgacctgaacaatgccgacgacgtgatgacccagttgttgaatatcgactggtatcgcgggctgattcagggtaagcagatggtcatgatcggctactccgactcggcaaaagacgccggcgttatggccgcgtcatgggcgcagtatcaggcgcaggacgccctgatcaaaacctgtgaaaaagccggcatcgagctcactctcttccacggccgcggcggctctattggccgtggcggcgcgccagcccacgcggcgctgctttcgcaaccgccaggcagtctgaaaggcggtctgcgcgtgaccgagcagggcgagatgatccgcttcaaatacggcctgccggaagtcaccgtcagcagcctctcgctctacaccagcgcaattctggaagcaaacctgctgccgccgccggaaccgaaagacagctggcgtcatattatggatgagctttccgtcatctcctgtgaaacctaccgcggttacgtgcgcgaaaataaagactttgtaccgtacttccgctccgcgacgccggaacaagagctgggcaaattgccgctcggctcacgtccggcgaaacgtcgtccaactggcggcgtcgaatcgctgcgcgcgattccgtggatcttcgcctggacgcaaaaccgcctgatgctgccagcctggctgggcgcgggtactgcgctgcaaaaagtggtggaagacggtaaacaaagcgaactggaagccatgtgccgcgactggccgttcttctccacgcgtcttgggatgctggaaatggtgttctcgaaagccgacctgtggctggccgactattacgatcagcgcctggtggcgaaaacgctttggccgctgggcaaagagctacgagacctactggaagaagacattaaagtggtgctggcgattgccaacgattcgcacctgatggccgacttaccgtggattgcggagtccattcagttaagaaacgtttataccgatccattaaacgtgttgcaggccgaattgctgtatcgttcccgtctgactgaagagcagggcaaatcgcccgatcctcgcgtcgaacaggcgttgatggtcacgattgcgggcgtcgccgccggtatgcgcaacaccggctaacgccaaaagaaagccgccctcacgcagttatgtgggggcggcatgaaatactgctgtcatcctcgtcattttttcaatatattcctgtctgcatttataaatctttcttagcaaaacgtgcggcataaagcaggtttgcttcagattcttttaaggttcaggcgttacgtttggcgctacgattaaagacaggctctcattatgcaatccacattactccagactaaacccgcgtttagctggaaagccctgggctgggcactgctctacttttggttcttttccaccctcctgcaggccattatttatctcaccggatacagtgggacaaacggtctgcgggattcgctactgtacagctcactatggctgatcccggtctttttgtttccaggccgcatccgggttattgctgccgttattggcgtcgtactctgggccgcctcgctggcggcgctgagctattacgtaatctacgggcaggagttctcgcaaagcgtgctgtttgtgatgtttgaaaccaacgccaatgaagccagcgaatatttaagccaatatttcagtctgaaaattgttcttgtcgcgctggcttatacggtggcggcgattttgctgtggacacgtctgcgcccggtttatattccatccccctggcgttatctggtgtcgtttgccctgctgtacgggctgatcctccatcccatcgcgatgaatacctttatcaagcataagtcgatggagaaaacgctggatagcctggcgtcacgaatggaacccgccgctccgtggcaatttattactggctactatcagtaccgtttacagctcgcctcgctgaataaactgctgaatgaaaacgatgccctgccgccgctggctaacttccaggaccactccggcgatgcgccgcgcacactggtactggtgattggcgaatcgacccagcgtggccgtatgagtctgtacggttatccgcgcgaaaccacgccggaactggacgcgctgcataaaaccgaccccgggctgaccgtgtttaataatgtggtaacttcgcgaccgtacaccattgagatcctgcaacaggcgctaacgttcgcggacgaaaagaacccggactggtatctgacgaagccatcgctgatgaatatgatgaaacaggccgggtataaaaccttctggatcactaaccagcagacgatgacggcgcgtaataccatgctgaccgtgttctctaagcagactgataagcagttctatatgaaccagcagcgcactcaaagcgcgcgcgaatatgacagcaacgtgctggcgccgtttaaagcggtgttagccgacccggcgccgaaaaaattcattattgtgcatctgctgggaacgcacattaaatacaagttccgctatccagaaaaccagggcaagtttgatggtaaaaccgaccatgttccgccgggattaagcagcgacgaactggaatcgtataacgattacgacaacgcgaacctgtataacgactatgttgtcgccagcctgattaaggactataaagcgaccgatccgaacggtttcctgctctacttctccgaccacggtgaagaagtgtatgacacgccgccgcataagacgcagggacgaaacgaagattcgccaacccgtcatatgtatacggtgccgttcctgctgtggacctcagagaaatggcaggcggcgcatccgcgcgacttctcacaggatgtcgatcgtaagtacagcagttccgagcttatccatacctggtcggacttagcgggcctgacctatgatggttacgacccgacgcgttccatcaccaacccgcagttcaaagagaccacgcgctggattggcaacccgtataagaaaaacgcgctgattgattatgatacgttgccgtatggcgatcaggtcggtaatcaatagcctgtatgttgcccgataacgctaacgcttatcgggcctggcgttcttctctcccgtagtccggataaggcgcaaagcgccgctatccggcaataattgcttgaggacatcggttttcgacgttactgtttcctctgtttgcgatcggcaggggattatcatgtatcacgacgtcagccaccttctctcccgtctcatcaacggcccgctgccgctgcgtcagatttattttgccagcgccagcggcccagcgccggaactggcgtaccaggtggattttccgcggctggagattgtgctggagggcgagcttactgacatgagcattaccgccccgctcattccttgcgatgttctctacgttccggctggcggctggaacatcccgcagtggcaaacgcccgtcaccaccctgagcattctgtttggcaaacagcagttaggtttcagcgtggtctactgggacggtcagcagcatcaaaacctcacgaaacagcacgttgcgcgccgtggcccgcgtatcggctcgttcctgttacaaacgcttaatgagatgcagatgcagccgcaagagcagcaaacggccagattgattgtcgccagcctactaagccattgccgcgatctgctcggcagccaaatccagaccgcctcccgtagccgtgcgctttttgaagccattcgggagtatattgatgaacgctacgccgcgccgttgacgcgcgaatcggtagcacaggcgttttatatctcgccaaattacctctcgcacctgttccagaaaacgggagccatcggctttaacgaatacctgaaccatacgcgactggaacacgccaaaacgttgctgaagggctatgacctgaaagtgaaagaggtggcgcaccgctgcggctttgtcgacagtaactatttctgccgcctgtttcgcaaaaatacggaacgttcgccttcggagtatcgccgccagtatcacagccagctaacggagaaataatccacacgccaataaagagaatacagtagataaaacgcgcatttactggattattgtaatatcaatgcaaaaacctcactcccccacatggcatacaacagcacgttatacgttaatcatcaccaacttgtgaagtaaatcacactttaccaagagcatcacatttgtccagtttttggcagatttgtcacatagcgcatccggggcacgctcctttatcctgtccataacgaaaactcacgaagagaaagactatggaactctatctggataccgctaacgtggcggaagttgaacgtctggcgcgcattttcccgattgccggcgtcaccaccaatccaagcattgtggcagccagcaaagaatctatctgggatgtgctgcccaggctgcaaaacgccatcggcgaagaaggcactttatttgcgcagaccatgagccgcgacgcgaaagggatggtggaagaagccaaacggctgaataacgccatccccggcattgtggttaaaattccggtaaccgccgaaggccttgcagcgattaaattgctgaaaaaagaaggcatcgtgacgctgggcaccgccgtctacagcgcgtcgcagggcctgctggcggcgctggcgggcgcaaaatatgtcgctccttacgtcaaccgcgttgatgcgcagggcggcgatggcattcgtatggttctggagctgcaaacgctactggaacatcacgcgcccgacagcatggtactggcggccagctttaaaacgccgcggcaggcgctggattgcttactggcaggttgccaggcgattacccttcctttagatgtagcgcaacaaatgctcaatacgcctgcggtagagtcagcaatagagaagtttgagcaagactggaaaaacgcttttggtaatctgaacctgtaggagagaaatgtatggatcgcattattcagtcaccaggtaagtatattcagggtgcaaacgtcatcgcgcgtcttggcgattatttaaaaccaatggcgaacaactggctggttgtgggcgataaattcgtgctgggatttgccgaagagacgctgcgcaaaagcctgacggatgccggtttgtcagtagaaatcgccccgtttggcggcgaatgttcgcaaaatgagatcgacaggctgcgcgccgtcgccgaaaaaagtcagtgtggcgccgtactgggtatcggcggcggtaaaacgctggataccgccaaagcgctggcgcactttatgaacgtcccggtcgctatcgcgccgaccatcgcctctaccgacgcaccgtgcagcgcactctcggttatttataccgatgccggtgagtttgaccgttatctgctgctgccgcataacccgaatatggtcattgtcgatacgcagatagtggcgggcgcgccggcgcgtctgctggcagccggtatcggcgatgcgctggcgacctggtttgaagcgcgcgcctgctcacgcagcggcgccaccacaatggcgggcggcaagtgtacacaggccgcgctggccctggcggagctatgctataacacgctgatcgaagaaggcgaaaaagccatgttggccgccgaacagcacgtcgtcacgccagcgctggaacgtgtcatcgaagccaacacctacctgagcggggtcggttttgaaagcggcggtctggccgcagcgcacgcgattcataacggtttaacggcgattccggatgcgcaccactattatcacggggagaaggtcgctttcggtacgctgacgcaactggtgctggaaaacgcgtcggtcgaagaaatcgaaaccgttgctgcgctgtgccattccgttggcctgccgattacgctggcgcaactggatattaagcaggatatcccggccaaaatgcgcatcgtcgcggaagcctcctgcgcagaaggtgaaactattcataacatgcctggcggcgcaacgccggatgaagtgtacgccgcgctgctggtcgccgaccagtacggtcaacgcttcttgcaggaatgggaataaggtcggcttgcaatgaaaaatccccgcaattgcgcggggatttttttgcccggtgggcatatgagacggtaggccggataagcgttagcgtcatccggcataagatttacaacagatcgaaacggtccaggttcatcactttcacccatgccgcgacgaagtccttcacaaacttctcgtgcgcatcgctacacgcgtaaacttccgccagcgcgcgcagtacggagttggaaccaaacaccagatcggcgcgggttgccgtgtattttacctcgccagtcaggcgatcccggccttcgaacagctcattagcgtcgtcggtgggcttccactcgtaacgcatatccagcagattagcgaagaagtcagtgctgagcacgcccggtctgtcggtaaagacaccgttctggctgccgtcaaagttggttcccagcacacgcatcccgccaaccagtaccgtcatttccggcgcggtcaacgttaactgctgcgctttatcaatcaacagcgattcggtcgtcgacacatccagacgcgcacgatagttacggaatccatcggcaatcggttcaagcagcgagaacatctcgatgtcggtctgatcctgacgcgcatccacccggcccggcgcaaaaggtacgctgatgctgacacccgcagcagcggccgcctgctcgataccgaccacgcccgccagcacaataatatcggccagcgaggctttattcgtcgttttctggagcgcttctaataccggcagaacgcgagccgcaacggcgttgacctcccagtcgcgctgaggcgctaatgccagacgcgcgccgttagcgccgccacgcttatcgccgccgcggaaagtagacgcggatgcccaggcaaccgaaaccatctcgctaatagaaagcccggatgcagcgatcgccgctttcaggttgataatgtcttcctgcgttggctggtagagcggttgcggcaacgggtcctgccagatcagatcttctttcggcacttccggtccgatgtaacgcgcttttggtcccatatctctgtgcgtcagtttgaaccaggcacgagcaaaggcttcattaaaggcctgtggatcgttaaggaaacgacgggaaatcttctcgaactccggatcaaaacgcagcgtcaggtcggtgaccagcatggttggcttacgttttttcgacggatcgaacgggtccgggatgatatccggcgcgtctaccgcttcaaactggatagcgccagccggactacgggtttgtacccactcatatttgaacaggttctcgaagaaatagttgctccactgggtcggcgtctgcgtccagaccacttccagcccggaggtaatagcatccgcgccaacgccgctaccatagctgctggcccaacctaagccctgcgcttcaatcggcgcggcttccggatcggcccctacatgggatgctgctgccgcgccgtgggttttaccgagggtatgcccgccagcgatcaacgccacggtctcttcgtcgttcatccccatattgccaaaggtagcgcgaatagcggcggcggcagaaagtggttcgccgctgtgatccggcccctccgggttaacgtagataaggcccatctcggtcgcgcccagcggcgcttttgccagcgcttcagggtgtcggtgagtcaaccaggctttttcatcgccccagttcacatccagatccggttcccagacatcttcacgcccggcgccgaaaccgaaggtacggaagccggagttttccagcgccacgttacccgccagaataaacaggtcggcccaggaaattttctggccatatttctgcttaatcggccacaacaaacgacgcgccttatccaggctgacgttatccggccaggagttaagcggcgcaaaacgctgttgatcacgacccgcgccgccacgaccatcaatagaacggtaggtgccagcgccatgccaggccatacgaataaacaaaccgacatagctgccccagtcggcgggccaccacggttgtgaatcggtcagcagcgccttgagatcccctttcagggcggagtagtctaacttgctaaactctttgcggtagtcaaagtcttcgcccagcgggttagaacggttggaatgttgattcaaaagatccacacgaagctggttcggccaccagtcgcggctggcagtccctgcgcctgcgcttcggtcatgccccccctgatggaaaggacattttccagtggataacgtgttatgggtatcgtcggtcgtgctcatatctcagctcccttttaaagtgttaccgttacgatatacaccaggagcaaatagatatagttgaattaatccacagattcgatagctaataccttttatatttttagttacagagatgtagatcaatatgagttgtaataaagctcccggcagggagctggaggttataaacccggtcttacgcccagcgtgtggcaaatggcataactcatttccgcacgattcaacgtgtagaagtggaaatccttcactccttcgcggcttaaaattttcaccatgtccatcgcaatgttagcgcccaccagcttgcgggtttctgcgtcatcatccagcccctcaaacatcagcgacatccaggacggaatgcggacattggtcatatcggcaaattttttcgcctgtttaaagttagacaccggtaaaatgccgggaataatttctacgtcgataccggcggaaacacagcggtcgcgaaaacgcagatagctttccacatcgaagaaaaattgggttatcgcgcggttagcgccagcatccactttacgcttcagattaagcagatcggcctgcgcgcttttcgcttccggatgtacctccggataggccgctactgaaatatcgaaatcggccacctctttgagcaaaccaaccagatcggcggcgtacatctccggcttaccgctgcccggcggcaaatcgccgcgcaaagcaacaatgtggcggataccgttattccagtagtcgcgggcgatggtgcgcagttcatcgcgcgtggcgtcaatacaggtaaggtgcggcgcggcctcaagcccagtacgctctttaatgcctttaataacactatgagtgcggtcacgttccccggagttggcgccatacgttaccgaaacaaacttcggtttcaggctgctcaggcgatcgatggagttccacagggtttgctccatttcactggtgcgcggcgggaaaaattcaaacgaaacgttaatctgaccctgtacttccgccaggctctgattcagggcttcccgctggttggcgtgaaaaaagctcataccttacctcatcaatcgcatgttattatttgttgtgctgtaaacatctatccgtttagacgtccagatgtaaaaatgacggaaaagcggaaggacgtcaactgaaaaatcacgccaaagaatgaggaatattcagcaaagttgaaaaaacttcattctccatcatcttgagcaataccttcttcatacggttccgggtgttcttcaacacataaaaaataaggcgtaaatgatatgattcaacgactttggcgacgcagggacgggggaaccagaagatgaacacagcgaatttcgagttgatacatatcatgatcgacgcgcaagcgtggcgcaatctaccgctgcatctgcgcctgtaccacgcttttcgccaattggtaatttccggtgcgttggctgatggcgcaaagctaccttccgctcgcgcgctggcccagcggctgcacctttccagggataccgtcgaaaatgcctattcccagcttcagcgcgacggctttatgacccgcaggcaaggggccgggagtttcgccagccgccagggggttccgcatattcaggggcagcacagcctgccgccatcgcctcgccagacgcccacgcttagcgcccgctggcagacgattgccgatcgcgccgtatctttcgatgcccgccgggtgcagacgtttacgctcggccttgcggaaacgcgaaacttcccgcaaaccatttggcagaattttgcccgccagatccagcgcgagcgggcgcatacgctaatgctgcatggcgatccgcagggagagcaggaactgcgccagcaaattgcccattatctcaattttgaacgcggcgcgaaggtcgacgcgcagcagattgtgattgtcagtggcgcgcgtcaggcattctggctatgcgggcaactgctggcagaggccgggcagtcggtggtgatggaaaatccaggctatcccggcgcgcgtcaggcattctctgccgcacagctcaaccttcttcccattgaagtcgatggagacggtattcgggtggataaactgccgcctgcgccgctggtttacgttacgccgtcgcaccagtttccctccggtcatttgctctctctggcgcggcgtcatgccctgattgactgggcacaggcgcataatgcctggattatcgaagatgactacgacagtgaatttcactacaacggcgcgcccgtcgcctgtatgcaggggttagatcgcgagcagcgcaccctgtatgtcggcaccttcagcaaaacgctctaccccggtctgcgcattggttatctggtggtgcctgcgtcgctggccgcgcactttgccgctgcgcgtaatttgcttgatggcgcaacgcccgcgttgacccaattgacgctggcgcgatttatcgcatccggccattttgccgcccatatccgcaccatgcgcagtatgtacgcggtgcggcaggcgtgcctggcgcaggccatcaaccagcatcttagtgattgggtgacgccggtagtgacgcccggaggattacaaatgccctgctggctgcatgaaggtattgacgaacaacagacccttaacgccgcgcggcgggccgggttaaacatcgccgggatgcgccagttctggctgacgcaccccgcgcccacgggctggctgttgggattcgccgcgtttaccccctacgagattgaaaatggagtcaagcttctgcgggctgcattatgcgccgaaaacgtgcgccaagccgggccataatctcataagggatggtatcgcaggcggcagcaacctcttccagcgtctggctcacgccaataaactccacaacatcgccagacgttggcatgatggcgctggcgtccaccataaagctgtccatgcagacccgccccaacaccggcaaccgaaccccgcgccagcacacgcccgccggaggacgcaaattacgcggaatcccatcagcgtatccggcggataccgtggcgatacgcagcgggcgagtggtagtaaccgtactgccgtagccaatcggcgtcccaaccggcacgtcttgcacgcgcaaaatggtcaacgtcagcgtaaatgccggttttaacggcgttgaaaaccacggctgggcgacgccgaacagcgcaacgcccggacggcaaagatcttcccgccaggccggatgcagaaacataccgcaggaatttgccagcgaataacggctggttgggaatgccttttttgcctgctggagtagcgtatgctgatagacatttaacgcatgatccggcctgtcggcgttggccagatggctgatgatatagtctggcgcagcccagccacgctggcgaaaaatcgcggccagccgcgccagttgctccggcgtcacccccagccgcgacataccagagtcaagctggatcaagaccggacgccgctgcgaccgagcctcctgtaacgccagccacgtcatcacctggtcaacggaattcaacaatggtgtgatctgttgtgcgcaacaaaacggcatcgcctgcggcatgacgccattaagcaacaccaccatcgcgtcagccgacaggatgttacgtagcgccaccccttcagaaagttgcgcgacaaaaaagatccggcaattggccgcatacagggctggcgcaatcgcctccgcccccaagccatagccattggctttcagtactgcgccgcattgcgcgggggcgacatggcgcgccagcgtttgataattgtcaacgacagcggcgagatctacacaaagaacgccgcacgccgcctgaatttcagcaagtttcatcattggtaaggcaacggatagttggtggttaatttagtcactttttgccgaatatcggcgcaaatatctgcaatattcggcgtcttgatggcaaaaataatttcactgatccagtccgcgatcagcgtaaaatcatcggccttcatcccgcgggtggcgcaggctgcgctgccaatgcgaatcccggaggtaatcgacggcggctgtggatcgcctagcaacgtgtttttattgaccgtgatccccgccagttcgagaaagtattccacctgagcgccggttaacccctgcgggcgcaggtcgataatgcccagatggcagtcggtaccgcccgttaacagcgtcaggccgcgctgcgccagttgctggcacatcgcttgcgcattttcgattacctgcccggcgtaacgtttaaattcaggctgtagcgcttcgccaagcgccaccgctttagccgcgataacgtgcatcaacggcccgccctgcaagccgggaaagatggcgctgtcgatttttttcgccagccgggcgtcgttggtcagaatcatgccgccacgcggcccgcgcaacgttttatgcgtggtggcggtaatcacatcggcatacgccagcggcgaggggaaacagccgcccgccaccagcccggcaaaatgcgccatatccaccagcagcatcgcgccgacggcatcggcaatgcggcgaaagcgggcaaaatcatagtgtcgtgggtaggccgatcccccggcgataatcagccgcgggcgctcacgcttcgcgatcgtctcaacctcatccatatcaataagaccgctatgcgcatcgacgccatagtgaaaggcgttaaaccatttgccggattgattgaccggcgagccgtgagtgagatggccgccgcattgcaggctcatgcccagaattttgtcgccgggtttcagcagcgccagatataccgcctgattcgcctggctgccggagtgaggctgcacgttaacataacgcgcgccgaaaagttgctgcgcgcgggttatcgccagcatctcaacctcatcaatgaacttacagccgccgtagtagcggtgctggtaatagccttcggcgtatttattggttaacaccgacccttgtgccgcaagaacggcagggctggcgaaattctccgaggcaatcagttccagcgagtgctgctggcgctgttgctctttattaagtaaatcaaaaagcggatcgttgtttatcatgcggttcccccgaaaattcatcatatgatgattttcgcagggaaagtttcccccgcaccccgccactttttacgcaggacgcagaccaccggatagaggggtaaatttcggcaggaacatgccgggaacgcggcgcgtaacccggcaaaattacagaagctacgccagacggttgatatccgcggtccacgaatgatccaggccagacataccgccgtccggcctgaatgcgctaaaggccattgcgcacaggcaagtaaccccttacttcttcacatccgcaacacgcattcctttgagctgctcatccgtgatggtgttgcccgccttaaagtaatcaactatcgcattcgacacatagtagccgccggaggtgttccgtgcctggccttccgtgaacgccgcaaaaccatcgccgccgtcggcaaggaagctgttggtagcgatgtgataaaccgccgcatcatcaatcggcttgccattgagcgtcagcacggtaacccgctggccgataggtttgctgctgtcatacttcatctccagccctttagacacctgcaacacgccgttgcttaatccggcgccatgctccatcaggctgcgcaattgtttaccggttaaatccatcgtgaccagttcattagggaacgggaaggtactgattaccgcccccatcgtcaccgcaccagccgggatttcgttgcggataccgccagagttagtaagcgctaactgggtgtctttccccgccgtaaaaagcagcgcatccgccgccagattccccagcgacgacgattcgccatacgcgcgggtcagctcaaccggcgactgcgccaccgtttgctgcacgactttatcgagctttttgttccagccgtcgatcacctgtttcgtttgcggatcgggcttccactcatcagcaaaaatggtcttcagctcgaagttcttcacggtaaactgatgcggcttttcctggtagtccagcaccagtttgccgacatcaataccgccgctgtccgttgagaggatcagcgtattaccgactttaatcggttccggcgtaccgacatgcgcgtggccggtaatcaaaatatccagcccttttacctgacttgcggtctgaatatctttatccagcgcgcgtcgcacatcggtattccccatgctggactggcgggccggggtgccttcgtggatcagcgcgacggtcagatcgactttacctttaagttcatcaatgtaacgttgcagccacttaatttcatcgcgagcctcaatgcccacgcgcgtcgcggcagaaaccgtatcattaaaagcaaagacaccgtgtaagccgattacgccaatcttgacgccatctttttcaacaatggtgtacggcttatcccagaaggatttactgctgtcctcataaaaaatattgccctgtacgatagggaatttcgcccggctcagttgcaacaatgtattgtcccagccatgatcgaactcatgattaccgatagtggcagcgtcatactgcatggtattcaaaatatcgataatcgctttacccttcgtcaggctgctgatatacggtccggtaaagtaatctccggcatcaaaaaaccacgtcgccttatttttggctttttcctgcttcaccagcgtagtgatattggcccaaccgccaatatcgcgtttaccgtcagcaatccacggtactttataaggctccacatgggcgtgtagatcgttggtgtaaataatggtgacatctttggcgcaggcccagaacggcagcgtgaacaaaataccggcagcaagcagttttactttcataaataagtccctttcagtcatataaagattcgctacgttacgttctgaaaggtttttttatgtgagagtcctcacatccgcgtaccgttttatgaaggcagaatcaacgacctgccaaaatcgttggtaaaatgtatgccgcctctgttcaccattaatgcctgcaaaagcgctggttgtcgcaatcttgggctgcctgactcgccggattatgtgtggccggactatcgcctgggttatccggcattgcattgtcgggcctgcggcagttatccaccgctcttcaacgagggggaatttcgccgctgggcgtctgcttacatcgcgcaatatgccaaagagcatggtcacttttgccccgattgctatcaaagaacatggattcgttatggacgtaatcccggcggaacgcagcgacttcagtgccagtactgtaagaaggtctggacgccaaaacagcacgcgctgaatgtcgccgaaacgccggaacagatttgcagtattccgctgctcgtaccgtttcagggagcgaatgccttccaacaattgtactttttattcagttttgatgctgttcgcggcaatatacttcacctttccagcaatttcacgttactttctgccggaaagagtttgcattaccactggaaaggaattgcgccgcccgagggcgagaagggcgatattattcaccgtatcgccattaaagaacggcaatttttacagcgcagccagttcgatgagattcagtatggcccggcggcgcttaaacgtaacgcgcaaggaacaatacttcgcccggtgattacggcgcatggtcattttcgggtgctgaaaaaccgctttcctgatgtcgcgacacacatcattgcccatgagtgttttttgcgcggcgcggtcattacggcatgggcggagcggtttcgccagcgtctctcctcgctgtggttcgttgaggaagagataaacgatgacgattgccgcgcagagtggcaactgttaggcaaaacatggcagggatggtggcaaaatcagtggcaactctgggggcaaggtcacaaccgcaaaatggtctgttcgttaaccggttcccacttagaacaaggtgtcgccgttaatctggcggccagtcgccgctttgttacctggctatggcaacaacctgaatttcagcaaagcgcccactgttccgccaaacgcgtcacacaaattctgtatttgctgacggaaaaatataactcacaatggaatcacatttaactcaatgatgtaatgccacgcataaaaaatcacagattatcattcagaaggcgctatagatttaatcacctcacatcctgcttttacacgctgaaaaagaatagagctatttgataaatggcccttcgttttgcgttaagatcggctataaacgttattcacataatcaatatttattatcaatttgaatagctctatacattcttattttctatggaaaacaagggataaatatggaaattactttaccgtcaatgtcagataaaaaatggacctgcgccgatctcctgagtagctaccgattctgggggatcacttttttctttttggcgctctcttttatcagttcgctgggatcgtcgtatggtgtttatttttggagtaaatcactgtctattccagccgatcgtattggtcttattctcgttggcgtaaatggcccatctgacgtagtcaggcttatcatagcacagcaatattgtgtctgacgcttagcgacgaaatccaaacattgcgggcgaatgcaaacgaaaatacaggtatacagagcggctggacgctattttgggcattgctgttcccccctgtcggcatagccattatccaggcgaagatgaaccgatttatcgtcgccaatgcagaaaacgcatctgacgaagaataaacagataccccggtttgcccgctgccggatctggcgaagccgctatccggcaggcgggcgtattacaatagctgcgccaggcggttgatatccgactgaatcgccccggcggtcacatcgcgacccgcgcccggcccacggatcaccagcgggttatcgcgataccagcggctttcaatagcaaagacattatcgcacggcagcagcgccgccagcggatgctccggacgcaccgcttcaacgccgacgcgcgctttgccattggcgtcgaaacgcgccacgtaacgcaacaccagccccagttcgcgggctgcctccagacgctgcaccatctgttcattcagcgcgtcgccgttttcgaaaaagtgatcgatagacccttcttcacagtgcgccggcaccaacgattctacacgcacctgatccggctcgatgtcgtatcccgcctcgcgcgccagaatcaccagcttacgcatgacatcttttccggaaagatcgacgcgcggatcgggttccgtcagcccctgctgccaggcctgatccaccagatcggtaaacggcaccgtgccgtcaaattgcaggaacagccaggatagcgtcccggagaagatcccgctgatcgagagaatcgtatcgccgctgtcaatcagatcccgcaccgtgtggttgatcggcaaccccgcgcccacggtggcgttatacagccagtaacgcccggttttttcaaacgcgtcatgaatctggcgatacttatcgctggcgcttgcgcccgccagtttattggcgctaatcacatgaaaaccgtggctggcgaaatcaaggtactgatcggccagttgctcgcttgctgtcacatccagcaccactaaatcatcatacggatgcgcacgcatccacaggaatagcgactcttcgtcctgctcaacggcttcatcatcaaagaatgccagcgcgcggctggcgtccagcccttcataattcaacaggctacggcggctatccaccacgcccgccagcacaaattcaaaaccagtacgcgcggaaagcgtgctttgttcacgggcaaatagttccagccaacgggagccgatgttccccttaccgaacagcatcaggccaatgcgtttttcggcgcggaaaacagactggtgcagcccctgaatcaggctctcagtcgggccggtacgcagcaccgccaccagactgatgccctcctccgactgccaggtaaactccactggctgacctttcaactgctgccagaagcgatggcagtgtagcggattgcgagtgacgcccgcaccgaccatcgccaccagcgccagcccctgccgcaggcgcaattcgcccggcagtccgacatcgtcgaggagtttcagtacgctatccgctacctcggcggtatagcagaactgcaatagctggcgatcgcgatgcacgcccaccgccagcggacgcgcctgcgcccgttttaaaatttggtcgagctctttgtgcgccagcctgaaatcctggctggcgggcacctgaaactcaatcagacagatatcatcgtgactggtcacgatacgcgcgcccgtcccggaagccagcactcgttcaattcgggttgacccttgatccggcgtgtagctacagcgcaactgcaaatcgatatcgctgccggacactggctgtagcgtgcgggcgtgcagaacaggcgccgccagacgcgccagctcgctggcttcgtccagacgcagcaacggcagcaggcaggcatctttcactttgcgcgggtcggcgctataaacgcccgcgacatcgctccagatggtcacgcgggaaacgcccgccaacgcgccgatttgcgtggcggaatagtcggaaccgttacggcctaacaggactgtttcgccgtcgtgattgcggctgataaacccggtcacgaccagacgtttgccaggatgctgcgccagtagctgttgcaataaaggataagatagtccttcatcaacctgcggctgtgcggcgcgttcggcgcgtaaaaatgcgcgcgcgtccagccaggcggcatccagcccctgctgattcaggacggcggacatcaatctcgccgaccaaatttcgccgtgtccgacgatctcagcatagacggcatccgttacgccgccgtcgagcaaggcggcaagacgttccagatcgctgataaaagcgctggttaagtcatctgccgcgtcggcgggaagcagcccgctaatcagatcgcactggtagcggcgtaacgtctgtaatacctgatgcgcagaaaggcgatcggtctggcttaacttgagccagctaatcaactggttggtggtactgcctgcggcggacactaccatcatatcgtcaggctgcgaatactccgccataatgcctgcgacacgcaggtaacacttcacatccgccagactactgccgccaaatttatgcagttgacgacctttcgcccctgcctgcgcaatcacactcatgtttaccccttgtttgcagcccggaagccattttccaggtcggcaattaaatcttcgccatcttcaataccggtggagatacgcagtagcgtttcggagatcccggcggcggcacgcgcctgcggcgacataccggcatgcgtcatggtggcggcgtgagagatcaaactttccactccccctaaagattccgccagcgtaaacagcgacagcccgcccagaaaacgacgtagcgtctcctcatccccatccagttcaaaactcaacattgcgccaaagcctttttgctgacgcgcggcaatctcatgtccctgattattcggcagcgacgggtgatacagttttttcaccaacggctgggtttgcagatatttcacaatcgcctgcgcgttgcgctgcgccagctccatacgcggcaccagagttcgcaaaccgcgcagcagcagatagctatcaaacgccccgccggtcacgccaatattattcgcccaccacgccagttcagtgaccatttccggatccttagcaatcatcacgccggccacgacatccgaatgaccattgagatatttcgtgcatgaatgcaacaccagatcggcacccaacgccagcggattttgcagcgccgggcttaaaaatgtgttatcaacgacgctcactgcgcccgcctcgcgcgccagccgacagattttcgcaatatccaccacgcgtaacaatggattacttggactttctaccagtaccagcttcggtttttcttccagcgccgcctgtaaggcgcgttcatcgccctgatcgacaaaccgcacacgataacagccgcgcgtcgccagactgtcaaacagacgataactgccgccgtagcaatcatgcggcgcgaccagcagatcgcccggcttgaggaaaacggtggtgaccagatgaatcgccgacatgccggtattcgtcaatactgcgcccgcgccgccttccagttccgctaatgcgcgctgaaccacatcacgcgtgggattaccgcggcgggaataatcatgcgcgcgcggctcattgaaaccggtaaagttataggtactggagagatggattggcggcacaacgcagccgtattgttcgtcatcgtttaatccgctacgcactgcgatagtggcctgtttacgcgtcatatgaagatattcctggctgagtcggtgaaagtcaggccacagattaaccactaccacaatagacgtcaatacatctggacatctaaacttctttgcgtatagattgagcaaaccgcaaatagccgttaaaattatatgcattagcgcacatctgcgaccgctaacttcgtgtcagggccgcgccactacggtaaactacgcgcgattatggtccgggctcaggttcagacctcaatattaatgacgaagaggattaagtatctcatggctgaatggagcggcgaatatatcagcccatacgctgagcacggtaagaagagtgagcaagtcaaaaaaattacggtttccattcctctgaaggtgttaaaaatcctcaccgatgaacgtacgcgtcgtcaggtgaacaacctgcgccacgccaccaacagcgagctgttgtgtgaagcatttctgcacgcctttaccgggcaacccttgccggatgatgccgatctgcgaaaagagcgcagcgatgaaatcccggaagcggcaaaagagatcatgcgtgagatggggattgacccggaaacgtgggaatactgatagcaaagcatgcggtcagaacgcctctggccgcgcttttttaacgatttcccctgtacacggctatctccgacattgttctaaacgttcatcttcccgaatagccctcggtggataaatttgtcagacatgataagtttctcttcgttattttcctgaaaaaattcccggcatgccataatcgatataattttattatatttaaaattccaatatttatttaatgtttcacgtagcaaagcgtacatgaataataatacaccgccatatatttactgaataaatagtataacgatgattattgttaaaaagaccatgaacacctcatatttgtgaccaacatcattattcccctccgcggattgttttacttttttaaatgttttttcatctccgataaataagaaggttaatatacattcattttatcgataatatcgaatggggaaataaatatgttatttacaaggaaagtcttacctgtattatgctgcctgtgtttgagcggcagcgttttggcctcaggcgttttagacccaaacaggccaatggtcgcatcagcagatgtcattccagtacatgaagggccattaggtatggtcgatgtcgccccctacggcggcgttttcccattaacagcaatcattaataaagccaatcataatgtacagaacgtgaaggttaccgttttagggaaaggggaaaaaggtatccctatcagttatgatgtcggcccgcaggctataaatacccatgacggcatacctgtatttggcttgtatccagattatgtcaataaggttaaagttgactggactgaagaaggtaaaaaacaaacttatacgtggtccatttacgccgcatcggtatcattaccctctactaccgggcaaactgccgttcttcctacggtagaaccggttaaagtcgatagctcgcttaaaaatcgcttatatctttttaaccatataacggggatgccaagggcaggccacattatgcatgtcgcaggcggcgcggcgaactgggattataccggtatcaactggattagcgatacgaatggcgatgttcgcggctatatgaatattgataaattccgtaaccaggatgatataacgcgctttggttccatgatgggcttccatcaggttaacgatggcaatcttatttttggccagggtcaacgttactttaaatatgatttcttaggccgcgttatttccgataaacgactgccaaaaggatttattgatttttcgcacgccattaccgaaacgccgaaaggcacctacctgctgcgtgtcgcaaaagaaaattatccattaaatggtaaatacaccatcaatactgtgcgtgatcatattcttgaagttgaccagaacggcgataccgtcgattactgggatctgccaaaaatcctcgacccctatcgtgacgatgttattctggcgatggatcagggagcggtatgtttgagcgtcgatgccgaacattccggtcaggtcatgaccaaagagcagcttgcaaaacaacccttcggcgatatcgcgggctccggcccgggccgcaactgggcgcatgttaactccgtcagctacgatcctcgcgacgacagcattatcattagctcgcgccaccagtctgccatcatcaaaattggccgcgataaaaaagtgaaatggatactttccgatccatccggctggaaaggcgaactggcgaaaaaagtgctgaaacccgtagacagcaacggtaaaccgctaacctgcgaagcgcaccactgcgacggtggatttgactggacatggacacaacataccggttggttagtgccatccaaaagcaccggaggtaaaaccgtcgtgaccgcctttgataacggcgatgcgcgcggcatggaacaaccggccatgccgtcaatgaaatattcccgcggcgtggaatatcagattgacgaaaaaatatgacggtttcccaaatgtgggaatatggtaaagagcgcggttttgactggtacagcgccattacttccgtcacggaatatcgcccggaaaccaaaacgatgttcatgtactcggccacagcgggaatgagcggtacaaatccaatcgtttccgttctggatgaagtcaaagacggtactcaggatgtgatgctggagctaaaagtacacagtaaccgtgctggtatgctgggttatcgggcgctgattatcgatccagagcagatgtttaaaaaataaagcgtgagagtaaaagtaaaacaggcggaagccaacttccgcctgaatggttaaaacgtattgtagttatgacattcgccttattgccctcggagaggaatgcaaaaatatcaatgaattaccaatccggcaccgacccgataagcgcagcgtcattagacaaacgccacaacataccgcgcctttgctggtgatatgtcatgaaaaatctctttatcgcctggttaagtttattgctatatggctgcacaacctttccacaagccgtaaaacctacgacaggcggacagccctccccgacggaaatctatatcgtcagtcatggctggcacacgggaattattgcgccggcccatgatgttaataccgttctgccacagcttaaaaaacggttcgctcaggagacgcagtggtatgaaatcggctggggcgataagggcttttatcagtcacaagaaataaccaccgcgcttacgctccaggccatgttctggtcatccggcgcggttatgcacatcgtcgccttttccggtcaaccagaacgctatttcgccggtagcgagataaaatcactgctcctgcacacaaaccagcgtaacagtctgatgcgttatctgggccgcagctttgcgcgtgacgcagagggtaatctgattccgttaaaacaaggaatttacggcgatagccagttttacgccgcgaatggccgctacggcatactcaatacctgcaataaatggacagcgaaggggctggaaagcgcgggactgactataaatccttcgttaaaactcacggcaggaagcgtaatgaaagcgattacggatcacagaatgtgtctgaacaaatactgttatccctagaaaacaaaaaaagcgccctgcggcgcttttttttctggcggtaacttatttgctgccagggatgctgaagcgcttgttgaagcgctcaacacgaccaccggtatcaacaacacgctgcttaccagtgaagaacgggtggcatttgccgcacacgtccaggttcaggtcgtgacccacggtagagtgggttttgataacattaccgcaagaacaggttgcagtaatttctacgtaattcgggtgaataccttttttcatggggaacctcagtgtaaggccgcgtcgctcttccagccctaacgccagacaccacgcgaagttaatagtaaagggtttgatgctcacaacacgcaccaaaggcggcgaatcatacagaatttgaccaccgtatgcaaactgatccgcgctcccttatcgtaatgtgtatactacccgacgaaatttcaagtcaggaagatgctatgtccgtcgcgcacgttgccttgcccgttccgcttccccgaacctttgattacctgctgccggaaggcggggtcgccaaagccgggtgccgcgtgcgcgtgccgttcggcaagcagcaagagcgcgtgggcattgtcgtctcggttagcgaccacagcgaattgccgctcgatgaattaaaatcggtcattgaaatcctggataacgagccaatcttttctccctccatctggcgcttactcctctgggcggcggattactaccaccatcccctcggcgacgttctgtttcacgctctgccggttttactgcgtcagggaaaaccagccagcaacgcgcccctatggtattggttcgccaccgaagaggggcaagccgtcgacatcaacagcctgaaacgctccgccaaacaacaacaggcgctggcggcgctgcggcaaggaaagatctggcgctatcaggtagccgagcttgattttactgacgccacgctgcaaacgctgcggcgtaaggggctttgtgagcttgccagtgaaacgcccgcgtttaccgactggcgggagcattatgccgtcgcaggagagcgcctgcggctaaataccgaacaggcgacagcagtcggcgcaattcacagcgcgtcggacggtttctccgcctggttgctggcaggcgtaatcggttccggcaagaccgaagtgtatctgagcgtgctggaaaacgtcctcgcccagggcaaacaggcgctggtgatggtgccggaaatcggcctgacgccgcaaacgatcgcccgttttcgcgaacgttttaacacgccggtggaagtgctgcattccgggctaaacgacagcgagcgtctttcggcatggctgaaagcgaaaaacggcgaagcggcgattgtcatcggcacgcgctcctcgctgtttacgccgtttaaaaatcttggcgtaattgtcatcgacgaagagcacgacagctcttataaacagcaggaagggtggcgctaccatgcccgcgatttggcagtgtatcgcgcccatagcgagcagatcccgattattctcggctccgccaccccagccctggaaacgctatgcaacgtgcggcagaaaaaataccggatgctgcgtctgacgcggcgcgcaggcaacgcccgcccagccctgcagcatgtgctggatttaaaaggacagcgtcttcaggcgggactggcgcccgcccttatcgcccgtatgcgccaacatctccaggccgataatcaggtaattttatttcttaaccgccggggattcgcgcccgcgctgctttgccacgactgcggctggattgcggagtgcccgcgttgcgatcactactacacgctgcaccaggcgcagcatcatttacgctgccatcactgcgacagccagcgtccggtaccgcgtcagtgcccctcctgcggctccacacatatgctaccggttgggttagggaccgaacagctggagcaggtgctggcgcccttcttccccggcgtgccgatctcacgaatcgaccgtgataccaccagtcgtaaaggcgcgctggagcagcatctggcggaagttcaccgcggcggagcgcgcattctgataggcacacaaatgctggcgaaaggccatcacttcccggacgtcacgctggtggcgttgctggatgtcgatggcgcgcttttttccgcagattttcgttcggcggaacgcttcgcccagctctacactcaggtttccggccgcgccgggcgcgcgggtaaacagggcgaagtggtgctccaaacgcaccatcctgagcatcccctgctgcaaacgttactgtataaaggctatgatgcgtttgcggaacaggcgctggcggaacggcaaacgctccagcttccgccgtggaccagccacgtcattattcgcgcagaggatcacaacaatcagcaggcgcccgtctttctccagcagttgcgtaatgtgattcaggccagcccgctatcagacgataagctgtggatcttaggtccggttccggccctcgcgccaaaacgcggcggccgctatcgctggcaaattttacttcagcatccttcacggattctcctgcaacacatcatcagcggcacgctggcgttgatcaatacgctccctgaagcgcggaaagttaaatgggttctggacgtcgatccgattgaaggatagtccccacgatgcgaggcggatcgtaaaattaaagatccatcacactttttatgaaaattctgtaaccgcttccacgcactatctgataaaaatgttttcgatgagtgttaccagggatagatctgcgccagcagttcccaggcgaggagaaagagtgaaatcgaacaagcaagttactgccgctacgatgaaggatgttgcgttgaaggcgaaagtctctacggcaaccgtatcccgcgcgttaatgaaccccgataaagtctcccagtcgacccgtagccgggttgaacaggccgcgcttgaagtgggttatttcccgcagtcgatggggcgaaatgtaaaacgcaatgaatcccgtacgattttggtgattgtcccggatatttgcgatcccttcttcagtgaaattatccgcggtatcgaagtgaccgcggcagaacaggggtatctggtgctgattggcgattgtgcccatcaaaaccagaaagaaaaaacctttcttaatctcatcatcaccaaacagatcgacggcatggtactgctcagttcccgactgccctttgacgccagcgttgaggagcagcgcaatttgcctccgatggtgatgtcgaatgagtttgcgccggagcttgaattgccgacggtacatatcgataacctgaccgccgcgttcaatgccatgaactacctgttggatttgggccacaagcggattggttgtattgcggggccggaaaatatgccgctctgtcactatcgcttacaaggttacgtacaggcattaagacgcagtggcattgtggtcgatccgcattacatcgcccgtggcgactttacctttgaagccggggcaaacgcattaaagcagttgcttgagcaaccgttgccgcctaccgccgtcttttgtcatagcgacgtaatggcgctgggcgccctctcctgggccaagcgccagggtctgaaagtgcctgacgatctgtcgattatcggctttgacaatatcgcgctggccgagttttgcgaccctccgttgacaaccgtggcgcagccgcgttttgacattggtcgcgaggcgatgctgctgttgctcgatcagatgcaggggcaaaatgtgagcagcggctcgcgtttaatggattgcgagctgattattcgcggttctacacgcgctttaccctaaagtaaatagctttaagactcacctgtctggtcaaaggcccgccgcttcagtaacatgacgggctgacgaacgaataaatacagcgaaacgatagtggcacaacgagattatgtacgtcgcggccaaccggctccttcgcggcgcaaaaagagcacctcacggaactcacggaagaagcaaagcaacatgcctgccgtctcgccggcaatggtcgcgattgcggcagccgtccttgtgacctttatcggcggtctgtacttcattactcaccataagaaagaagagtccgaaacgctacaaaaccagaaagtcaccggcaatgggcttccgccaaaaccggaagagcgctggcgttacatcaaagagctggaaagtcgccagccgggcgtgcgtacgccaacggaaccgtccgccggcggcgaagtcatgaatccgaatcagctcaccagcgagcagcgtcaactcctggagcagatgcaggcggatatgcgtcagcagccgacacaacttaacgaagtgccgtggaacgagcagacgccagaacaacgccagcaaacgctacagcgccagcgtcaggcgcagcagcagcagcagcagcagcagcagcagcagtgggctcaaacgcagcctgttcagcaaccacgcacgcagccgcgggtaaacgaacagccgcaaacgcgcacggtacagtccgccccggcgcaacccgcgcgccaaagtcagccgccgaagcagacggcctcgcagcaaccttatcaggatttgctgcaaacgccggcgcataccagcgcggcagcgccaaaagccgcgcccattacgcgcgcgcctgaagcgccgaaggcgacagcagagaaaaaagatgaacgtcgctgaatggtgcaatgtggttcattcaaaggcgccgagcaggcagaaagcgtccgcgctcagctggcgtttgaaggctttgactccaaaattaccaccaataacggctggaatcgcgtggttatcgggccggtgaaaggtaaagaaaatgccgacagcaccattaaccgtctgaagatggcgggccatacaaactgcattcgactcgccaccgggggttgaaaccctcaaaatctcccccatctatacttgcattatgccccgtacgccgtacggggccgcaattcagcattagtaaccaaggggtctgctcgtgacaacaatagtaagcgtacgccgtaacggccacgtggtaatcgccggtgatggtcaggccacactgggtaacacagtaatgaaaggcaacgtgaagaaagtccgccgcctctacaacgacaaggtcattgcgggctttgcgggcggtactgctgatgcattcacgctgttcgagctgtttgaacgtaaactggaaatgcatcaggggcacctggtcaaagccgccgttgaactggcgaaagactggcgtaccgaccgtatgctacgcaaactggaagcgttgctggccgtcgcggatgaaaccgcttcgctcatcatcacgggtaacggcgatgtcgtgcaacctgaaaacgatttaattgctatcggctccggcggtccttatgcccaggctgccgctcgcgctctgttggaaaataccgagctcggcgcgcgcgaaattgctgaaaaggcgttggatattgcaggcgatatctgcatttacaccaaccatttccacaccattgaagaattgaccgccaaagcgtaaggacctctcatgtctgaaatgaccccacgcgaaattgtcagcgaactgaacaaacacattatcggccaggataacgcaaagcgttccgtggcgattgcattgcgtaaccgctggcgtcgtatgcagcttgatgaagagctgcgccacgaagtaacgccgaaaaatattctgatgattggcccgaccggcgtcggtaaaaccgaaatcgcccgtcgtctggcaaaactcgccaacgcgccgttcattaaagtcgaagccaccaaattcaccgaagtgggctatgtcgggaaagaagtggactctatcatccgcgatctgaccgatgccgctgtgaaaatggttcgcgtacaggctatcgagaaaaaccgctatcgtgcggaagagttggcggaagagcgtattctcgacgtactgatcccacccgcaaaaaataactggggccaggccgaacagcagcaggagccttctgccgcccgtcaaacgttccgcaaaaaactgcgcgaaggccagctcgacgataaagagatcgagattaacctcgccgccgcgccgatgggcgtagagattatggcgcctccgggcatggaggagatgaccagccagttgcagtctatattccagaacctaggcggtcagaaacagaaaccgcgtaagctgaaaattaaagacgcgatgaaactgttggttgaagaagaagctgctaagctggtcaacccggaagagctgaaacaggacgctatcgacgcggttgaacagcacggcatcgtgtttatcgatgaaattgacaaaatttgtaagcgtggcgaaacctccggcccggatgtttcacgcgaaggcgtacagcgcgacttactgccgctggtagaaggctgcacggtttcgaccaaacacgggatggtcaaaacggatcatattctgtttatcgcctctggcgcgttccaggtggcgaagccgtctgatctgatcccggaactgcagggccgtctgccgattcgcgttgaacttcaggcgctgaccaccagcgatttcgaacgcattttgaccgagccaaacgcctccgtcactgtgcagtataaagcgctgatggcaactgaaggcgtcaatatcgagttcaccgattccggtattaaacgtattgccgaagccgcctggcaggttaacgaaaccaccgaaaacatcggcgcgcgccgtctgcataccgtactggagcgtctgatggaagaaatttcctataacgccagcgatttgcacggccaaaacatcacaattgatgcggaatatgtgagcaaacatctggatgcgctggtcgcagatgaagatctaagccgttttatcttataatcgcgtccaatgcattttcatcactgttgatggggctgaaaagccccatttttattggcgctaaatatgactgaacaacaacaaattagccgcacccaggcctggctggaaagcttacgacccaaaaccttacctctcgccttcgcggcgattatcgtcggtacggccctggcatggtggcaaggctatttcgatcctctggtcgcactgctggcccttatcaccgccgggctgttgcaaattttatccaacctcgccaacgattacggcgacgctgtcaaaggcagtgataaaccggatcgcatcggaccgctgcgggggatgcaaaaaggcgtcatcacccagcaggagatgaagcgggcgttaatcattaccgtcgtgctgatctgtatctccggactggcgctggtggcggtcgcgtgccatacgttaaccgattttgtcggcttcctgattttgggcgggctgtcgattatcgccgccatcacctacaccgtgggtaatcggccctacggttatatcgggctgggtgatatctctgtcctggtattctttggctggctaagtgtcatggggagctggtatctccaggcgcatacgctgattccggcgctgattctcccggccaccgcctgcggtttactggcgacggcggtgctgaatattaataacctgcgcgatattaatagcgacagagagaacggcaaaaacacccttgtggtacgacttggcgatgtcaacgcgcgtcgttatcacgcctgcctgttgctaggcgcgctgctctgtctggcgctgtttaatctgctctcgctacacagtccgtggggatggttgtttattctggccgcgcccttgctcattaaacaagcgcgctacgtaatgcgcgaaagggagcctgcggcaatgcgcccgatgcttgaacgtaccgttaaaggcgcgttgttaaccaacctgttatttgtgattgggatactcttaagtcagtgggccgtttaactgacaaatatcaattaacaattgatgattttgccaacagtatacttagcgcgatatactaaaaattctcgcagcaactgaacgttaagcctatgaaatacgatacttccgagctttgtgacatctatcaggaagatgtcaacgtcgtggaaccgctgttctctaattttggagggcggtcgtcgtttggcggacaaatcatcacggtaaaatgtttcgaggacaacgggttgctgtacgatctgctcgaacaaaatggccgtggtcgggttctgctggtcgatggcggcggttctgtccgtcgtgcattagttgatgcggagctggcgcgtctggccacgcaaaatgaatgggaagggctggttatctatggcgcggtgcgtcaggtggacgatctggaagagctggatatcggcattcaggcgatcgccgccattccggttggcgccgcaggtgaaggcattggggaaagcgatgtgcgcgtcaatttcggcggcgtgacgttcttctccggcgatcatctctatgccgacaacaccgggattatcctttccgaagacccgcttgatatcgagtgatcaaaaaaggcgccgtaaggcgccttttttatgcgttgtcgctgattgccggatgtcggcttacgccttatccggcccaccggtatccgcattctaaatcctctatagatttcgcgtcagggcaaggcggcaagaaagtgaatccccaggagcataggccactatgtgactggggtgaacgcacgcagccaacgccgccataacgtgaaatatgacgaggattagacttcttccatacgaccaagcagcgcctgtaaacgttcctgccagccgctctgctgttccttcagaaaattattttcacgctcgagttcttcacgctgatgctgtgcagactgcacttcctgcgtcaggctgttgttcttttctttcagctcttcaatttccatctgtaacagggtgatggtgtcaatcgcctgctgtacttttgcttccagtttctcaaacacttctaaagacatgatcttacctctcctgaattgcaaggcgacgcttcacgtaaacgcgcacaatatatagtatcgattgtatgaagccccgctctcgctgtccagcgacataccgcgtagatcgcggtttgcagcaattttcatccatctcctggtaacattcattcaataacttaaaagtgttaacatattggttaatgaaatgattcaattcactctcttctgctgtctcaaaatgcgcctcatggcgcgataacgctcattttattgacgcagtacacacattttgatttcgatatttctcgtttttgctcgttagcgataaattaacagtgtgcctacagggcatcgtggatgtccatgacctcctcgcataccaataatcattacatactcttcaggatccgattatgagtcaaacatcaaccttaaaaggccagtgcattgctgaattcctcggtaccgggttgttgatttttttcggggtgggttgtgtcgctgcgcttaaagttgccggagctacttttggacagtgggaaatcagcgtcatctggggtctgggagtagcgatggctatctacctgacggcaggtgtttctggcgcacacctgaacccggcagtgaccatcgcactctggctatttgcctgtttcgacaaacgtaaagttgttccttttattatttctcaagttgccggcgccttttgcgcagcggcgttagtttacgggctttattacaatctttttgtggacttcgaacaaacccaccatatcgtccgtggcagcgttgaaagtctcgatctcgcaggcattttctcaacttacccgaatcctcatatcaattttgtgcaggccttcgcggttgaaatggtgattaccgctattctgatggggctgattctggcgctgaccgacgacggtaacggcgtacctcgcggtccgcttgcgccactgctcattggtttactgatcgccgttatcggtgcctctatggggccgttgaccgggtttgcgatgaatccggcgcgtgactttggccccaaaatgttcgccgggcttgccggctggggtgaaattgcgtttaccggcggtagagacattccttacttcctggtgccactgtttggccccatcgtcggcgccattctgggcgcgtttgcttatcgcaaatttattggccgtcatttgccgtgcgatatctgcgtcgtggaagagaaggactccaccgcggccacacaacaaaatgcttcgctgtaatctgattacgggacaaaattatgactgaaaaatatatcgttgcgctcgaccagggtaccaccagctcccgcgcggtcgttatggatcatgacgcgaatatcgtcagcgtatcacagcgtgaatttgagcaaatttatcctaagccaggctgggtagaacacgacccgatggaaatttgggcgtctcaaagctcaacgctggtagaagtgctggctaaggccgatatcagttccgatcagattgccgctatcggtatcaccaaccaacgtgaaaccgcgatcgtctgggaacgtgaaaccggcaaaccgatatacaacgctattgtctggcagtgccgtcgtaccgccaatatttgcgaacagcttaaacgcgacggcctggaagattacatccgcgacaataccggtctggtcgtcgacccgtacttctctggcactaaagtgaaatggatccttgaccatgtggaaggttcgcgcgaacgcgcgaagcgtggcgagctgctgttcggtacggtggatacctggcttatctggaagatgacgcagggccgcgtccacgttacggattacaccaacgcctcacgaaccatgctgttcaacatccatgatttggactgggacgataaaatgctggacgtgctggatatcccacgcgcgatgctgccccaggtacgtaaatcctccgaagtctacggccagaccaatattggcggtaaaggcggtacacgtattcctatcgccgggattgccggggatcagcaggccgcgctcttcggccaactgtgcgtaaaggaaggaatggcaaagaacacctacggcaccggctgctttatgctgatgaacaccggcgagaaagcggtaaaatcggaaaacggcctgctgaccaccatcgcctgcggcccaagcggcgaagtcaactatgcgctggaaggtgcggtgtttatggcgggagcgtccattcaatggctgcgtgatgaaatgaagctcatcagcgacgcattcgactccgaatatttcgccacgaaagtgaaagataccaacggtgtctacgtggttccggccttcaccggtctgggcgcgccgtactgggatccgtatgcccgcggcgccatttttggcctgacccgcggcgtgaactctaatcacattatccgcgcgacgctcgaatccatcgcttaccagacccgcgacgtactggaagcgatgcaggccgactccggtatccgcctgcacgctctgcgtgtggacggcggcgcagtggccaacaacttcctgatgcagttccagtcagatattctcggcacgcgggtggaacgcccggaagtgcgcgaagtgaccgcgctgggcgccgcctatctggctggcctggccgtcggttactggcagaacctggacgagctgcaggaaaaagccgtcattgagcgagaattccgccccggcattgaaaccaccgagcgtaactaccgttacagcggctggaagaaagcggttaaacgcgcaatggcgtgggaagagcacgacaagtaaggtcgccatccggcaaaatctttgtgcggaggcaactccgcacacacatcaattattccctccctcccctgtgctacactgcgcgccactcctttttgctacgagtttgttatgagacgagaacttgccatcgaattttcccgtgtgaccgaagcggcggcgctggctggctacaaatggctgggacgcggcgataaaaataccgcggacggcgcggcggtcaacgccatgcgtatcatgctcaaccaggtcaacattgacggcaccatcgtgattggcgaaggcgaaatcgacgaggccccgatgctctatatcggcgagaaagtcggtaccggccacggcgatgcggtagatatcgccgtcgatccgattgagggcacgcgcatgacagcgatgggtcaggcgaacgcgctggcggtactggcggtcggcgataaaggctgcttcctgaatgcgcccgatatgtatatggaaaaactgattgtcggtccgggcgccaaaggggcgatcgatctcaatctgccgctggcggataacctgcgcaacatcgcggatgcgctgggtaaaccgcttggcgatctgaccgtgaccattctggcaaaaccgcgtcataacgaggttatcgcagagatggccaaactgggcgtacgcgtgtttgccattcctgacggcgacgtcgcggcctcaattctgacctgtatgccggatagcgaagtcgacgtgctgtacgggattggcggcgcgccagaaggcgtggtatccgcagcggtgatccgcgcgctggacggcgatatgcagggacgtctgctggcgcgccatgacgtgaaaggcgacagcgaagaaaaccgccgcattggcgaacaggaactggcgcgctgcaaagcaatggggattgaagcgggcaaggcgttatgcctgggcgacatggcgcgtagcgataacgttattttctctgcgaccggcatcacgaaaggcgatctgctggaaggaattagccgaaaaggccatatcgccacgacggaaacgctgctgatccgcggcaaatcacgcaccatccgccgcattcagtctatccactatcttgatcgtaaagatcctgatgtgcaggcgcatatcctctagcgcatttgttagttagagccttccagcctcgcggggctggaaatctttctcctgacgaacgaagataaggttagcgattcagaacaggagaaaaccatggccgattgggtaacaggtaaagtcactaaggtgcaaaactggactgacgcactgttcagcctgaccgttcacgcccccattaatccttttactgcaggccaatttaccaaactcggactggagatcgatggcgagcgcgttcagcgcgcgtattcctatgtgaatgcgcctgacaatccgaatttagagttttatctggtgacggttccgcaaggaaagctcagcccgcggctggcggcgctaaaacctggcgatgaggtacaagtggtcagcgacgcgtcgggtttctttgtactggatgaagtgcctgactgcgagacgctatggatgctggcgaccggaaccgctattggcccgtatttgtctattctgcaatatggccaggatgtcacgcgctttaaaaatctggtcttagtccacgccgcacgcttcgccgccgatttaagctatctgccgctaatgctggaactgcaacagcgttatgaaggcaagctgcgcatccaaacggtggtcagccgggagagcgtgccaggctcgcttaccgggcgcgtgcctgcgctcattgaaaacggcgagctggaaaaagccgttggattaccgatggataaagagaccagccacgtcatgctgtgcgggaacccgcagatggtgcgcgatacgcagcaactgctgaaagagacccgacagatgactaaacatctgcgccgccgaccggggcatatgacggctgaacattactggtgatgttttaccgaatggcagctagggcttatccggcctgcaaatcatcaccaatctgtaggcccggtaagcgtcagcgccaccgggcaaattacggtttaccgcccgtttacggttctgccttaaacttcacgtcctgtgtcgctttcccaaacttattttccccctgaacaccgacaaacgcgcccagatcgataagcatcatcaccaggatcagcgtcggaataaatcgcccgacgacccactgccacatccccggcaacatcacccagtttccggccagcagcatccacgccagaatcattagcaacgcccacgcgccggaacgtccccggtcatgcagacgtttgaccatgacggcggcggtcggccacagcaggcacaccaggcaaaatgccgccgtttggatatcaagcaggtttttccccgccagcgaaaatagcgccagcatcccggcaaaccagaggccgatccaaatccagaaatcacggcgtccgatacgccctttaaatgagaataaccattgctgtatggtcatgtaagttccttatattttgccttccgctacagtttacccttttgacaagcccgacagttatcgttttaatcgtgagcagtcctaacgaaaggtaagattgatgaagccaggatgtactctgtttttactgttgttttctgctctcaccgccagcataacggcgcacgcgcagctctcttcatcgaccacgacagcgccctatctgctggcgggctcgccaacctttgatctttctattagccagtttcgtgagaactttaaccgccagaatcccgatctgccgctcaatgaatttcgcgccattgagaatagccgcgataaggcgaatctgacccgcgccgccagtaagattaacgaaaatctgtatgcctccacggcgctggagcgcggtacgctcaaagtgaaaagtatgcagattacctggctgcccattcaggggccggaacagaaagcggcgaaagcgaaagcgctggaatatatggccgccattattcgcactgtcgccccgttactgacaaaagagcaaagccagaaaaaactgcaaaagatgcttatcgccggtaaaggtaaacactattacgccgagaccgaaggcgcggtacgttatgttgtcgcagataacggcgaaaaggggctgaccttcgcggttgaaccgattaagctggcgttatctgaaaatctggaaggggcgaattgatgacaaaaagcaaagcctttccggggatgaatctctatactgtttcacagaccatgctgctctgacgagcggccatcttccttaattcgctgactaagcgtggagaaatgaaatgcgacatcctttagtgatgggtaactggaaactgaacggcagccgccacatggtaaacgaactggtggctaacctgcgtaaagaactgacgggcgtagcaggctgcgacgtggcaatcgctccgccggaaatgtatatcgatctggcgaaacgcgctgctgccggcagccacatcatgctgggcgcgcagaacgttgatctgaatctgtctggcgcattcaccggtgaaacttcggctgaaatgctgaaggatatcggcgcgcagtacattattatcggccactccgagcgtcgtacttatcacaaagaatctgacgagctgatcgccaaaaaattcgccgtactgaaagaacaaggtctgacgccggtactgtgcatcggtgaaaccgaagcggaaaacgaagcgggcaaaacagaagaagtgtgcgcacgccagatcgacacggtactgaaaacgcagggcgcggcagcctttgaaggcgcggttatcgcttacgaacccgtatgggcgatcggtaccggtaaatctgcaactcctgcgcaggctcaggcagttcacaaattcatccgtgaccacattgctaaagctgacgcgaaaatcgctgaacaggttattatccagtacggcggttctgttaatgcgtccaacgcagccgaactgttcgcgcagccggacatcgacggcgcactggtaggcggcgcttctctgaaagctgacgccttcgccgtgatcgtgaaagcagcagaagctgctaaacaggcttaattgccaatcaatgtctgatggcgctgcgcttatcaggcctaccagccgagtgcttatgtaggcctgataaggtaaagccgccatccggcatttatgctgtggagggtaagaaagtagtatccccggcaaccttaaacatcgccctccagctccgcgtattctcaaccagccgatcatcacgaaataacgcactaccagaaacaacacgatcgatgccctgtgcaatcagcgaaggcaactgatcctgcgttaacgacccatcaataacgataattttaccttcgcgtttatcaccaagtagacagagaagctgtgccacgcgctcgtacaaatcactggagcgcattttactgccgtatccagggttcactgccagtagttgaataacctcaacgtcgctcagaatagggataatgacatccagaggcgttgccgggcataaactaatcccccggatcaccggcatttcaccgtcaataacgggcacggtctgctgaccaagccagcttagcgtatgatgcagatgaatatcgccttcagcctgaagcgtgatgcagtgtgcgcccgctttcacgcaggcttgcgccgccgcccattgatccgctaccatcaaatgaacatctttgataaaagtttgcggcagttgcccaactgcccatggcccaacggtaaactgtgggcaaaattgaccatccatcaaatccaaatgcaacagcggctggtttaacgcttccaactgttgcagatagcgatgcaacgcaatccactgccctgccagaatacccacactaagcggatatgacgctaacaatgccacacatgcttcgcgcgttaatccggcaaactggctgttcatgagcgctccttaaggcatcaaacccataaaaactttttttgtccgcggaccggtcatcaacggttcaagctgctccacgcaagttttatagtgtggcgttgtcttgtgaaaagcgacggcctgttcatcaacgtaggcttcataaatataaaatcgcgtaggcacctgcggatcctgcagaacatcaaaacgcaagttacccggctctttaattgagcccagatgattctgccgaaaaacatcgataaattgttcaaccttgtcatcatgaacgttaatttcaaccagcgtaacgtgcatcattaaccccctgattattccaaataaaataacagtcatccccatctcctcgcatcggtaaaagatggggaagcgatctcatttaacctttctcactcaaaaacagctcataagcacgctctgctgtttcgttatgatgaacgacagcatgtaccgctttaatcatggctaccggatcttctgactggaatatattacgccccatatctacgccagaagccccctggtcaatcgcctgatagcacatttccaatgcttcacgttcaggcagttttttaccgccggcgatgacaatcggcaccggacaacctgccgcaatacgctcaaaacctttatcgacataatacgttttgataatttgcgcccccatttccgcagcgatacgcgttgccagtgaaaaataacgctggtcgcgagccatatctttacccaccccggtcactgccattattggcatcccgacgcgtaacccggcatcaatcagttgaataatatttttaatcgactgatgttcatgttcactaccaatataaacctgtgcggcagcagcacagctattcaaccgcacagcgtcatccatcgccaccgcaaccgcctcattgcttaattcagtgagaatagaatttgccccggacgcgcgtaaaacgactggtttattgattgccggaggtaccacactgcgtaatatgccgcgagtacacattaagacatcagcatattcaaagagcggcgcaatattgatatcaatacgctcaagtccggttgtcggcccctggaaatatccatggtcaaaggccagcatgaccgttttcctggtcctgggattaaaaatcctcgccagtctggactgcattccccaatccagcgcgccacagccttttaatgagaacaaagtgttagtttgtggtttatcggtgtgaaaatctttgccatctttaatatcatctaaatcagccattctttactccgtcgatacataacagttatcagaaatcatatttgtcgatattgtctttgttgaaaatgacacgctctggcaataacacaatgccgttaccttttgcctcatagtgatatccctgctcactattaggtgaaacggtgactttgccgatgccgggaatatccagtgaatcaccgacattcattggcatatttttcagcaacgcgttggcgacatatacggaaatttttccctgttggacgacatcccacaggccaaactctttaacagtgccgcgctgaacataagggcgcattacattcggcgtactaaaaccaacaatcgcgagattattacgtttaaggttctccgccgcctgtgccgcagcaggtaaagcgttagcgtcaggcgcgatgatggcatccagatcgggatacgctttgatgataccttccgccgtctggagcgatttcgtggcatcgttatagccaaactgggtagtgactatctcccaccctggatgttcctggctaattttggctttagcttcttttacccactggttctggtcggtcaccgttgggctggaatagaagaaagcgactttcgctttctctttgtccacctgatgagcggccatctctaccagcatgctgccgagctgttttggcgtcccttgattgatatagtaagaacggcactccggcttggtatcggaatcccaggttaatattttcacgcctctttgcattgcccgcttcaacgccgggcacaggccatcaggcgaaacggcagaaacgataatggcgtcatacccctgattgacaaagttattcaccagttgaacctggcctgagacgctgggctctgtagggccatcgtaagttacgtcaatgcccagcgcttttcccgcttcctgcgcgccattgccgccgctggtaaaaaagcccacgccaaccagtttgggaataaaagcaatccgctctgccgcctgcacggtcattaccgcagatgccagaccaaacgcagtgagtaaggcgatcattttaatgctgtgtcttgccatttttttctccataaatttcaaaaggaaatcatgcctgatgcgcattgcgacggcgtgagtaccattcaaggatttggtgacgatgcaaactgacggaacgaccaacgacaacaacaatgagaagcgcaccggacaatgcgctggaaatttgattcggcactccggccatctgtagcccctgctgtaaaaatcccaccagcagcgccgccaacgcggaccccataatcgacccggagccgccataaatattggcgcctcccagcacaaccgccgtaatggtcggcatcaggaaagaggcgcccagatccgaacgtgcggagccaaagtaagaaaccagtaatacggcggcgatcgcggaggcgcatccggtcatggcatacacggtatacaacgtgcgattcaccgggatcgcgctgtactgcgcgacacgggcgctctggccaatcaggaaaacgttgcgtcccatatgcgtgcgatgcatgagcagccagaaaaacagacagcacacaagaaaaaaaataagcggcataggaataccaagaaatgaaatattggcaaagtcagtgaacgctgtgggaaatccaccaataccttcataacccgtggcgccagccataccagataacaataatgcgctaccaccaaataaatacatggttcccagggtaatcaccaacgggtttacgccggtataaataataagtccggcatttatcagcccacatattgcgccgagtagtagggtaataataatcgctaaaggtagcggcataccgagctgaaacagcacacccagggtaatcgcgcatagcccgattgtagaaccaaatgaaatatccataccaccgctgacaataaccattgttagcggcaaagcgacaataccgatacaaataaaatcgctagtgctaaaaagtaagacattaatatctaataaacgtggattaatcagaccgaaagccagaatttcaaagatcaataaggctgccagcgcaatttcccagctatagcgtcgccatggattcatcatgccacctctttgtttttattctgttgtgcgtgcgtttttgcttccgcctgtagtggagtgggtggtgatataaaacgggcatatttctggcggcgcagattgcgttgtaatgcgcaacgcagccgcccatcgaataccagtacgcccaacaataccaggccagcaataaaatcgttccaccaggcggggatgcgcagcagcactaacacactatcgatttgcgtaagaaaataagcgccgagaatagcgccgatgaccgtgcctgacccgcctaacaggctaattccccccaatacgcaggccgcgatggctttcatttccagccccgtgccggtttgattgggaatgaagccaatctgcgaggcaaacacgattccagccaatgccgccataccgccattaagtgaaaatgccatgatgcgtaccatctcggtacggacacccaattgccgggcgccctgcaggttatcgccggtggcgtaaaaattgcggccaaaggcggttttcgccaggagccaggccataagcagcgctaacaccagggtaaaccagccgattgcggaaattcccagaaacaccggagcagagagttgctttaagcctgcgggtaatccttcaatccattttccccctgtccatagcagcatgatcccacgatacaagcccagcgttcccagcgtggcgacaatggcgggtatcttcaaccaggcaaccagtacgccattaaaaaatccggcgacaattcctaatattagtgtggccaggcaggcgaccggcaggctatagccggcgtttaacattactcccagcaataccgcgcacattcctgtcgtcgagcccaccgatacatcaatattgcgggtgagcattaccatcgtcgcgccaatcgccaacagcatcaaaatttgcgcgctactgaaaaccattgtcagcgtttgcacgctcaaatactggctatccagcgcgccaagaaacacgaataaacagactattgccagcagtgccgtcgcttcccggttattttggatgaatttcaacatgttgcctccgacgcaccatgttcgccaaacgcaacgtgcatgatggtatcaacgttaatttcctcgccgcataacgcaggcccccccagttccccctggtgcatgacatatacgcgatcggccatctgctctatctcttccagatcggaggaaataaacagcaccgcgacattttgttgcgcgatactgcgcaacagctgataaatatcgctgcgggcggagacatcgacaccgcgggtcggttcatcgacaatcagtaattgcggagaggcctccaggcatttggcaatcaatactttttgctggttaccgccggataaagtacgcgccgcctgttcggcattattgagtttgatatttaacgcgcggtggtaacgttcaagggtggcgttatcccgctggggctttatccaaaatcctttttggttgtgggtcagcgaacagacattccatgccagggaagcgtcaagatacagcccggatgactgccgatcttccggcaaatagaccaggccgagctgcaaccgctgttgggttgtcagggcgttaatttcttcaccattgaacagcatccgccccgcattgaccggtctaataccgtacagcgtttcagccaattctgtgcgtcccgcgccgaccaacccggccaaaccaaggatttcgcctgcccgcacctcaaggttgatattcataaaaccttcgcccgtcagtgactccagcgctaataccgtcgcgccgcgttcgttctgcgggcggctgccaggcaattccagccacaacttttgactcgcggaaagactgacgccctgcgttgccggggtgatagcttgaataatctcgtcggtagaaaggtcatgcgtttttctgaataatgcgattttaccgtcacgcatcacgctaacgcagtgagctaactgtctaatttctggcagcttatgagaaataaatacaattccgacaccctttttcagcaactcttgcagacgcgtaaataaccggtcagtttcggctggcgttaacgacgccgtgggctcatcaagaattaagattcgcgagtcgcgcatcaagccgcgcataatttcaacgatctggcggtctgcaacatcaagcgtacccgcagcgctcgccggatcgagttggcatcccatcgcctttaatagctgctgcattttttccgtggaggcctgacgtccctgcaagccaaacaagatattttcccgcacagataaactcggaaataacagaggctcctggggaaccaggtaaatgccatactggtgcgccttcagaggcgttaaatgactgcaacgcacaccagcaatatcgatagtccctccatctggcgggactataccggcaataatcttcattaatgttgatttacccgcaccattgccgccaagcaatgcgtgcacctctcccgcatgcagagtaaagtcaattccctttagtacttcgacgccggaataacttttataaatgttctgcacacaaatcagaggggatgcagtattgtgactgatttgcatgttgcctccgctccctcaatgttgactgacgggactgaacaaatgttttttgaaaaagaaattgttcaaaacggtagtagttatttggtcaaaaaactctcatccagatcacgttttctgaataaatgaatttttagatgataaatgttcagatttggcgcgtttttgtggcgttaatcacggttatttcggagtgataactgaacaattgtgttaatgatttagaaatgttcaaagtaaagccaggttatgacaatgagcgataatacgttggtatctgattatggaatgtgcgaagaagagcaggtggcgcgtattgcctggttctactatcacgatggattgacgcagagtgaaatcagcgagcgtctggggctaacccggctaaaggtttctcgtctgctggagaaagggcatcagtccggtattattcgcgtacaaatcaactcccgtttcgaagggtgtcttgagtatgaaaatgccttgcgtaaccacttcgcattgcagaatatccgcgtgctgccggcattacccgatgccgatattggtctgcgcttaggaatcggcgccgcccatatgttgatggagtcactgcggccacagcaactgctggccgtcggctttggcgaagccacgatgaccacattaaaacgcctcagcggatttatctcggcgcaacaaatccgactggtcacgttatccggcggcgtggggccgtatatgaccggaataggccagcttgatgccgcttgtagcgtaagtattatgcccgcgccgctgcgcgcatcatcgcaggaaattgcctgcacgctgcgcaatgaaaatagcgtgcgggatgtgatgctcacagcgcaagctgccgatgccgccatcgtggggattggggcaattaaccagaaagatcaagccagtatcttaaaatccggctatatcactcagggtgaacaactcatgattggccgcaaaggcgcagtaggcgatattctgggctatttttttgatgctcatggcgaaattattccagacatcaaaatccataacgaattaattggcctgaagttaaattcactttccacgatcccaactgtgattggcgtcgccggcggcgaacaaaaagcagaagctattattgccgctatgcgcggtaactatatcaatgcgctggttaccgatcagaaaaccgcagggaaaataattcaacttattgaaaaataaaaaataaaataacacttacctcaattcaataaacaataactgacaggattttatgtaacgatgtaaaaatagccgagggtaaaaaaatggctcgactctgtacccatactgaatcaggacattacctgatggctcttgacgccggtaccggtagcgtcagagcagtaatttttgatctacaaggaaagcaaatagctgtcggtcaagcggaatggcagcatctggccgtgccggatgtgcctggttcgatggagtttgatcttgccaaaaactggcaactggcttgccagtgtatccgtcaggcactacagaaagccgccatccctgcaacggctatcgctgccgtatcggcctgttcgatgcgtgaaggcattgttatttatgacagtaacggcgaacccatttgggcctgcgctaatgttgacgcccgcgcggcgcacgaagtcagtgaattaaaagagctgcacgataacacctttgaggaggaagtttatcgttgctccgggcaaacgctggcgctcagcgctattccgcgtctgctctggcttgcccaccatcgtccggatatttatcatcgcgcgtcaaccgtcactatgatcagcgactggatggcctttatgctcagcggcgaactggcggtcgatccctccaacgcaggcacgacggggttattggatctggtgacccgcaactggaaacgtagtctgttacagatggcgggcctgcgttctgacattctctcgccggtaaaagaaaccgggacactgctcggtcacatttcacagaaagcggctgaacagtgcgacctgcaagcgggtacgccggtcatcgttggcggcggcgatgtgcagttaggctgtctggggctgggcgtcgtacgcccggcgcaaacggccgtgctgggcggaaccttctggcaacaggtcgtcaatcttcccgcgccggtcaccgacccaaacatgaacgttcgcatcaatcctcatgtgatccccggtatggtacaaaccgagtctattagcttttttactgggttaacgatgcgttggttccgcgacgccttttgcgccgaggaaaaactaatcgctgaaaggttaggtattgatgcgtattccctgctggaagatatggccagccgggtgcctcccggcgcgcacggtgtgatgcccatcttctctgacgttatgcgttttaaacgctggtaccatgccgcgccgtcgtttatcaatctgtctatcgatcctgaaaaatgtaataaagcgaccctatttcgcgcgctggaagagaatgccgccattgtttccgcctgcaatttacagcaaattgccgcgttttccggcgtacaggccgactcgctggtttttgccggcggaggatctaaaggcaaattatggagccaaatccttgccgacgttacgggactcaccgttcacgtacctgtcgtcaaagaagctaccgcgctagggtgcgctattgccgcaggcgttggcgtgggtatctggccatcgctggcggaaacgggagaaaagctagtgcgctgggatcgggagcataaacctaatcctgaaaatttcgctgtctatcagcaggccagagaaaaatggcaggccgtttatcaggatcaacgcgcgctggtcgatggtggcttaacgacatccctctggaaagcgccaggcctgtaacaggagaataagcatgcaaaaaacgaatgagaagaatcatgaataccgctttagtgataatggccctaaatacttaatccgtgggccgggctgcgatatgggcgtcgtcatactacaaccagggcagtcattccctaaccatcgccataataccgcttgtgaggttttttataccctaagcggtgaagtgtgcctgtatctggaaggaacacctcatatcctgcaaactggagatgttttacagtgcgaaccaggggaggcacattatctcattaataacggcgataagccctagaaaggcgtgtttattaaatcgccgcatctggaaaatgacagccaccccgcagatccaccggcctggtaacgcccacgccatcgccagattttgccggatagcgccacgagagccttgtccggcctccaaacggcattcgttaatgcaatatcaagctgtcatttgatgacctgttggttcaagatatcacactgatgatcctgaatttcctcggcagaagcgcgattgaaggtcagtaaattacgctcggtcgccagcaggacaaaagagccatcgctttggcgtaccaccgccagcgcgctacatcactgcatccccgcccgcgcaggaactttccctggtcccatcgccaccacagcagcaaaaaatagcagtgcggtcataaactccggcagtagcgaagtcgcccacagaaggatagtaatgccaacgatgatggaagggaggatcagaggataggacaaccagagcgacatacctgtctcctgacgattttttcagcaagaatacgacggacagtcaggcaggtaaacgccagatatagtggggttatcgcaggattaagtggacagatcagtgataatgaatttcaccaaagtattcagacagcacgtaatagcggcaatactcaaaagggctgtccttcccggcctgaaacgtctgtctggcgacggataacagcggtttattgggggcgatttgcaatttttcgcacaggtcagcggaaggtaaaatcgcctcaactttttctatcgccgagtcgcttgtgacgtttaataacgaataaagcgacgtatgctccagcgcctgcggtgtgagttgcagatcgggaaagaagctaagatcgagatagatcttttcatggttaaacggacggttattcaggcaacgaatacgcgaaatatagagatagtgatgctgtgcgggcaggctcaagccgtctgcctgagcgtcgcgcgcgcggcgcggcgcgatttccagaatacggttctcaatcgccacgctggcgtcctggagatcgcgggtaataccgcgaaacgtgtgcccgtagctcacgccttccggcaccgagcacaccaccgaaccactcccgcgctgcgacgaaataatgcccgcattgattaattcgctccaggcctgtttaaccacaatcagcgagacgttgtaggatctggcaatctctttttgcgtcggtagttggctacccaaaggcaaagacccgttctggatctgctgacagatgataaaaaatagttgcttataaagcggagtaaagctcgttttatcaacctgcaagctgcgcacctcacgtcttcgccagcaggggacgttttaccgtccccggcagggtgaagtcgctaccctgcgatttgcctggccagttctgccaaatcgaaatgattcatacgatccaaagtcgttaaataatcggcgggaaaagcctccacgccatggaatgcgccggaaatcgccccgaccatggtggcgacagtatcagtatcattgccgatattaacgccggagataatagcatctacggcagaattcggacaacacgcgaacaggccaaaggccgcgggcaccgcttcactcacgtgcagcccggagccaataatatcggcaatatccactatcgccgtttcccaatggcgatgacgtttaccgatatctacggccagctcaatgcgtcgggcaacggaaggacctgccaccatcatcgccccttgctcctgcgccagcagatagcccctttgcgcaccgtaaataccggcggcaataatgctgtctgcattggtctgcgctcttaacgcctcgctggttgccgccgccatcgccgctgcgccggacatcgccagcacgttattatgcgtaaaacggcaaatctgcagcgcgcagtcaatcgccgcgtcaatatcacccgggtgcagcaccgccgctggccaaatcttcatggcggcgccgttcgttgcctccgcattacccttattaatgatctgtaccgactgtttctcgccttccagctcaccctgtaaagaggcgcggttatcattgaatattgccttcattgccgcacgcgtcgtcgggccggtaaagttggcgtagtacgggtaatccagccactgctggaaagcttcgcgcatcgcttcgtcgctgacttcacgctgatgacgcagcagcgcatccatgatgtacttcgcctgaataaaatcatccgtgcacatccccgcttcattgcagcgcccaaacgtgtccgcaggcggtttttgaaaggtcgtcacccagccgccaaaatagtcttttatttgctgctgggtgcgtacttccgtcgcggctcccatcgcgtccgcggcggcggcgcccaccaggcatcccagtattttgttttgatcaacgtgcatgatgactccttatttcacggtcatggcttgtgccagcgaatggctggacagaaaagtgtttagctggtcgggaaacggcagagcggtcattgcgccttttgccgtcaccgccatagcgccgcaggcattggcattgctgatggcttccgccagcagggcatgatcccagcaatttgcgcgggaaagggtgaacagcaggccgccgacaaaagcatcgcctgctccggtggtatcgacgacatcgacgcgtggtgcgggaaaatggaactccccctcggcggtaatcaacagcgcgccatcggcccccagcgaaatgatcgtggtgtcacagcctagatcgcgcaggtaataacgcgcatcctgccagtgactggccccgctgagctggcacagctcatctgccgagactttgcagatagaagccaacgcggcggaccgggcgatcagttcagggatttcatcggtattgcgccacatcttgctgcgtaagttgacgtcgaataacacgtagccaccggcttctcgcatgcgtctcgccccttccagacatgcttcgcgagcgggactgtcggtgaggccaattgagctgaagtaaaaccattcgtgctgcctgaacggcggcaaatcctgcggcgaaacgtaggtatcagcccccggatgcaccagataggtaaagctgcgttccccgtcagccgtcaggttgacgatcagcaccgcgctggtcagggccgcatccagccgcagcgaagagacatccacgccgttatcctgaaaaacctggcgcaggaaacgaccggcgtcatcatcaccaagacaaccgataaaaccgcactccccgcccagcctggcaacgcatacccccacgttcgccgacgctccgccggggcatttcagatagctgttctgtttttccggcaccagatcaacggaggcatcgccgataacccaaaccttattcatggccttcatttgcgcctccttatgcctgtttctgcgccagggcgagctgaatatcacgataatattcattattaatcagatactttttcatcagcagcccaaccgcaaggtggaacagagccggaatgagcgtcatcatcagcgcaataccggtgagcgaacgcgcgctctgttcaacatcggcctgatagccaaagtggctcagcaggaatccgagtatcccgcccgcgatccccatcccaaacttctggaagaagaggatgccgccaaacgccaacccggaaacgcgcagaccggttttcttttctccgtaatccaccgcttcggcgatagaggaccagaacaccggcatttacatatcgcagaagaaattaataagaaaatagaacgcaaacgccaggataagattttcacgcccgacagagaaatacatcagcgcgctcaggataaaggtaataatctgggtgtagcggaacatcttaattttgtcccagaacttggttatccaggtggtggcaatcatcgctaaaatagaggcaacgacgccggtagtcaggaagggtgaaatcaggctatctccgccgttcagataatacttggcgtaataagcggcaacggaaccgcgaataacataaccgcacatcagcagcagaataacaacgccgagaataatccactgatcgttacgtaacagatatttaaactgtttccccaccgatagcgaggtaatctccggctcgctgcgttcacgcgtggtgagaaaacagaagataaacagcagcgcacccattgcccccattaagcccatcgaaaactgatagcccaaagccttattaccctgccccagccagacggcaagcatcggtacaacgatagtcaccagaaaagcggcaatcttggtcatcacaaagcgataaccgttggcgcttaaccgctcaacggggtcgctggtaatgacgccaatcatcgaaatataaggaatggtgatcgcggtatagaccagggtcataagaatataggtgccataggcccacgctagcttggccatataagccatgtcaggcgtaataaacatcaaatacacggcgaaaccaaaaggaatggcaaaccacagcagccacgggcggtaacgtccccagcgcgtgttcagtttatcggtcagaacccccatggccggatcgataatggcatcaatcatccgcacaaccacaaacagtacgccaacatcagcggcgctcaggccgtagatatcggtatagaaataggcgaggagcagctgcatggcgataatcacaacgtttatcgccatatctcccgcgccgaagccgattttttccacgatagaaagtttcatgttgatattcctttacgcttaacagcgcaaatctggtgaacaattaatgatgtcactacatgaaataaaaacgtttttatatataagccatccatcagacaatctatggaggctatgaagagagtgtaacgaaccaccaaaagatataaaggtatacctttatatcttttggttggtttcacatatttttatagacacgatcttaccccagttttaaaccgggataagaatcaataagataatgagcaggggggtgtaacgaaaatcagcgggaagacaaaatggcgcaactatggtcctgaatctcttccgccgatgcgcgattaagcgtcagcaggttacgctcggtcgccagcagaacaaaagagtcgtcgctttggcgtaccaccgccagcgcatagcgtcccatatgatcgcgcgcttccggcacctcttccgccagcatcataaacggactacgctgcgccagttcgctctcggttacccggcgcgccaggtattcatgccccatcagatcgcccggcagcggaagccagcgagtgctgatgcgcgtgagatcgttatccagttgttcccgaacgtcaggacggatgcaagaaatatggatatgcaaatggtcctgtgaacgaccaagccgcgaattaatcgccagcgagaccgcgctatccggaatatcatgcccgtattttttactcatatagccgcgagcctgccaggccagccagaaaaagttgggcgtagcgggttccagcaatagcgggctttctgtaccgttgatacggtaggtgggcatcaataaatattgcaacggaccgtgacgatctttaaagatgacatagccggcgcgaggtttgacttccgcgcaaggcgctgggttttgatgctgtaactgatcgggcaggcaccgttcaagcacgatttcccgtaatgcatcaggattgccggaaaatttccagtaaccgacgcccgccgcggcgacaatcactatcaccgccagtaaaaagtagcctgtttttttcatgatatgcgttccctgtgacccatagacggggaagagtaacgcaaaattgtggcaaagaaaaaacccggtaacataatacgttaccgggtttataaacggtttagcgtttgctgatttggtcgaacgtaccgccattagcaaagtgatctttttgcgccttcacccagccgccaaacacctcgtcaatggtgaatagcttcagcttcggaaacgcatcgtcgtattttttcgccacgtcagcatcgcgcggacggtagaagtttttcgctgctatctcctgcccttccggcgaatagagatacttgagatacgcctccgccaccgcattcgtccctttcttctcaacgactttatccaccacggacacggtcggctctgcgaggatagattcactcggggtcactatctcgaatttatctttacccagttcgttcgtcgccagcagcgcttcgttttcccaggcgatcagcacatcaccgataccgcgttcaacgaaagtattggttgagccacgcgcaccggagtccagcacttcaacgtttttaaacagggctttgacaaagtcctgggctttggcctgatcgttattgttgtggtgcagggcgtagccccatgccgccagatagttccagcgtgcgccgccggagcttttcgggtttggcgtaatcaccgacacaccgggtttaatcagatcgttccagtcatgaatttgttttggattgcctttgcggaccaggaaaacaatggtggaggtgtaaggtgctgagttatccggcagacgcttgatccagtttttatcgatacgaccacgttcagcaatagcgtccacatcgtaagccagcgccagcgtcacgacatcggcttcaatgccgttaatgacggaagtcgcctgtttacctgaaccgccgtgcgactggcggatcacgacgttgtcgccggtttcctgcttccagtgcgcgctaaacgctttgttgtactgctcgtacagctcacgcgttggatcgtacgatacgttaagtaactgaatatcctttgccagaatgctggttgacgccagcaataatgtgaaccccacgccccactttttcatcgcccgactcgcttatgttgtgttgtgatgagcaaagcgtgccagaaagagatccaaacattaaagaataaaaaaagattggctataacttcgaggaataaatctgagggattgccggatggcggctagcgcctaatccggcctacacgtttctgcaacctgtaggcctgataagcgtagcgccatcaggcgcgcaaaaacaatcagtacagttttttcgcgcactccatccagtcgcttttgaacggacgcttcatgttttcaatcgcatcgatgatgtcatgatgaacaagctgctcgttctggataccgacacaacgaccgccatggccttccagcagcaggtcaatagcatacgcgcccatacgggaagccagaatgcgatcgtaaggtaccggggaaccaccgcgctgaatgtggccgagcaccgtcgcacgcgtttcacggcccgtttctttttcaataaagtgcgccagttcgtcaacatcgcacatatgctcagtaatagcgacgatagcgtgttttttccctttcgcgatcccggctttgatttcggccaccagatcttcgcgattaaattcaacttccggcaccacgataaactcacagccgccagcaatagccgccgccaacgtcaggtcgccgcaataacggcccatcacctcaacgatagagatacgctggtgagaagaggaggtgtcacgcagacggtcaatcgcttccactacagtgccgagagcagtgaagtagccgatagtgtagtcggtgcctttgatgtcgttatcgatagtgcctggcagaccgatgcacgggaagcccatttcagtcagacgttttgcacccatataagaaccgtcgccgccaataactaccagcgcatcgataccgcgttttttcaggttttcgatcgcgacagcgcgaatattttcgtcacggaattccgggaaacgggcggaaccgaggaaagtaccgccacggttgatcatgtcagatacgctgtaacggtcaagctgaaccatacgatcttcatacaggcccagatagccgtcataaatgcccatgacttccagcccttccgtcaacgctgcgcgcacaacaccgcggattgccgcgttcatgcccggcgcatcaccgccgcttgtcaacacaccgattttcttaatcatgactacctctgaactttggaatgcaaaatgaaatctattgccggaagccgatttcgcacttcgaaacgatccaacgaatatacagatagtataacaatcccttcctgctgaattgattcaggtcaggccaaatggcggtaatttatacacaaaatgctggcctggctcactttttaacaatcaattatacaagctcgaacttcctgccttccctggggacgactgaacagggatcctgatgaataatgacatctgaacccggaaaacgccgcaaaatcgcctgctctacctggtcagccacaaaatgcgcctgaacgagcggcagattatcttccatttccaaatgaatctgaataaagcgagtcggccctgactgccgcgtgcggagatcgtgcgcgccgctgactcccggccatgacgtcacgatatcaataatttcctgtcgttccgcatcgggcagcgcgcgatccaataatgactgcaccgcctcataccccatacgtaacgcgctatacaaaatatagatgccgatacctaacgcaaacagggcatccgcacgatgccaaccgtaccaggataaccccagcgcgataagaatcgctccgttcatcataacatcagactgataatgaagcatatccgcccgtaccgcctgactttgggtcttgcgtaccacccagcgctgaaacgtgaccagtataatagtgcatatcagagcgatgacggtaacgccaatccccacgccggggtcgttcattggcgtcggcttaatcagattctggatactggtcaaaaacaacgccgaaccggaaataaacatactttgcgccagcgccgccagcgactccgctttaccgtgaccaaacgtatgttcatcatctgcgggttgcagcgaataacgcacgaccaacaaattcgtcaatgacgcggcaatatccaccagcgagtccaccaacgccgccagaatactcaccgatcccgtataccaccacgcaaaaattttgatcaaaagtaacgctgatgccatcgccgttgccgcgatagccgcccggctaaccagccgtccataggtttgattcataaatactcccgctatcttctgccggtagtataacggatggtttaaaacagtaagctaataacagaatgacaaactggagataaaaaaaacccccacatcatgtgggggaagacagggatggtgtctatggcaaggaaaacagggttgttactgggaacgtgagttgctactactcaataatttcaacgatgaacttttttgccattgcgccacgtcgcgcagttgctccattcgttgctgatgcttttcattcaaaaccgcttgctgctccggcgttaacaggcgatacatctggttacgcacgcgggccatttcgacctggcgggcaacctgctcttgcgccattttttctgcctgagcgcgcacaacgctttcatcaaatttttctgcggtgacaagccgatgcattgtctccatttcgctaacattaacaggaggctgttcgtgccttgcctgctgcataagatctcgcatctgctgacgctgatgttcggttaaacttatgccgtcaaacatatgattttgcgcgctacgctgcgtggccccgtcaccggggtgccagttatcgcttgtaacaacttcagctgcgtggcttaaaaaactgaatgccagcgttgaggccataacagcagcggtaactttgcgcatcgcttgctcccaaaatcttttctgtcgcgattcaacgagagacagtttacgattcgggctgcaaacatgcgtcagggggtgtaaaacaacgtaaagtcatggattagcgacgcctgatgacgtaatttctgcctcggaggtacgtaaacaatgaataaaatcctgttagttgatgatgaccgagagctgacttccctgttaaaagagctcctcgaaatggaaggttttaatgtcctggtggcccacgacggcgagcaggcgcttgagcttttggatgacagcatcgatttacttttgcttgacgtcatgatgccgaagaaaaacggtatcgatacgttgaaagcgcttcgccagacacaccagacgcctgtcattatgctgaccgcgcgcggcaacgagctggatcgcgttctcggccttgagctgggcgcggacgactatttgcccaaaccgtttaacgaccgcgagctggtagcgcgcatcagggctattttgcgccgttcccactggagcgagcagcagcagagcagcgacaacggctcgccgacgctggaagttgatgcgctaagccttaatccgggtcgccaggaagccagtttcgatggccaaacgctggagctgaccggtacggaattcaccctgctctatttactggcgcaacacctcggccaggtggtttcccgtgaacatttaagtcaggaagtgctgggtaagcgcctgacgccgttcgatcgcgccattgatatgcatatttctaacctgcgccgcaaactgccggaacgcaaagacggtcacccgtggtttaaaacattgcgtggtcgcggctatctgatggtttccgcttcatgataggaagtttaaccgcgcgcatcttcgccatcttctggttgacgctggcgctggtgctaatgctggtactgatgttgcccaagctcgattcacgccagatgaccgagctgctggacagcgaacagcgccagggattgatgatagagcaacatgtagaagctgaacttgcgaacgatccgcccaacgacctgatgtggtggcgtcgcctgttccgcgcgatcgataagtgggcgccgcctgaacagcggttattactggtgacctctgaaggacgcgtgatcggtgctgaacgcagcgaaatgcagatcattcgtaacttcattggtcaggcggataacgccgatcatccgcagaagaaaaaatatggccgcgtagagatggtggggccgttctccgttcgcgacggagaggataattaccagctttacctgattcgaccggccagcagttcgcaatccgattttattaatctgctgtttgaccgcccgcttctgttgctcattgtcacgatgctggtcagttcgccgctcttgctatggctggcatggagtctggcgaaaccggcgcgtaagttgaaaaacgcggctgatgaagtggcgcaaggcaacctgcgtcagcatccggagctggaggcgggtccgcaggagttcctcgccgctggcgccagttttaaccagatggtgacggcgctggaacggatgatgacctcgcagcagcgtttgctgtcagacatctcccatgagctgcgaacgccccttacgcgcctgcaactgggtaccgcgctgctgcgtcgtcgtggcggcgaaagcaaagagctggagcgtattgaaaccgaagcgcagcgtctggacagcatgatcaatgacctgctggtgatgtcgcgtaaccaacagaaaaatgcgctggtcagcgaaacgatgaaagccaatcagctatggggcgaagtgctggataacgccgcctttgaagccgaacagatgggcaagtcgttaacggtaaattatccgccggggccgtggccgctctatggcaacccaaacgcactggaaagcgcgctggaaaatattgttcgtaatgcgctgcgctattcacatacgaagattgaagtcggcttctcggtggataaagacggtattacgatcacggtcgatgacgacggaccgggcgtaagccctgaagaccgcgagcagatcttccgtccgttctatcgcactgatgaggcgcgcgaccgcgagtctggcggcaccgggctggggctggcgattgtcgaaagcgccatgcagcagcaccgcggctgggtgaaggctgacgatagcccgctgggtgggttgcggctcacgctgtggctaccgctgtacaagcgaacctaaaaaccatcggcctgcgaatgcaggccgattttttatctcgccgtcgagatttaccgggaaatgtctggcgctaaaatccactcggcgctgtcgttccacacgtccatccgggtaattttgccatcgcgcacttcgaaacgatcgataaagcggttatcggcaaacgggcgaccgtcgggccattcgccatacaacgtaccgttggaataaatcacaacgtaatcatcatgctgcaccgcatcaaacttgcccagcgccttcttcacccacttgtagcgagcgccgttaaactgcgcgatatctgccgcgcccgccatcgcccggcctccggtgaaggtaattttcacctccgggtgcatatacgttgcggcgcgttcagcatcgggaatcatcgaggccaccaaaaattcttttacgatcgccaccgcattttcagcttcagtcataatccttcctttcattttggcggagttttatccccccacagtcgtctggcgctatcttcaattttgccgctcaaacgacgcttctgcatggtgcggctccagctcgccgacagcccggcggcgctcagcagccggtgatattgttcgtcatcaaacggcatagaccaggcgataacacccgcttcatgaaccgagacatcgctcagacgcgacgccagttccagcggcgcatcgctggagaccttacctggcgcaatgacccgatacaaccagccagtttttccgctgttctgcataaggagggccatgtcgctgatggcaaagtggaaattaagtttaaagcatggagagcgcggctgagtgacctggatcaacgcctcgccccagcggtagatgtcgccaataaacacgttgtgttcggtcattccgtccgtcgacagattctcgccaaacgccggggcgcaaaacagcgtcgcctgctcggggaactggcgaatccaatcagcatagtgttcgcgggggtaatgacatagcgcgcggtcggggccgccgtggattttcttttcggcctgctgatcgcctgccagacccagctcggtcagcatgagttcgccgtcgatttgcaccttggcgatagcgctcgggcggctgccgtcatagtcacgaattttgccaataaacacgtcaaccggataatgcatctgctgctccttacgcggatacaaaaaaagcgagtcatcagactcgcttctacagacgtgcaatgcaaattattttttagcggcgaaacgcgctgctgcttcgtcccagttcaccacgttccagaactctttgatgtagtccgggcggcggttctggaatttcagatagtaagcgtgttcccacacgtccagacccaggatcgggaagccggaagcgccggaaatggcttcacccatcagcggggaatcctggtttgcggtagaaaccacagccagtttgtcgcctttcagcaccagccacgcccagccggagccgaaacgggttgctgctgctttttcgaattcagctttgaagttgtcaacggaaccgaagtcacgctcgatagccgctttcagatcgccctgcagagtggtgccttttttcagccctttccagaacaggctgtggttagcgtggccgcccgcgttgttacgcagcacggtttttttgtccgctggcacctggtccagtttagtaatcagttcttcaaccggcaggtcagcaaactcaggcagattttccagcgccgcgttagcgttgttgacataggtttgatggtgtttggtgtggtgaatctccatcgtctgcttatcgaagtgcggttccagtgcatcataagcgtacggcagggatggcagtgtataactcataatcatctccattattgtcgagcggcacagtgttaacgccgcgtaagcagttggttcattatagttaattaaatgatattgaaaatgattatcaatgccgtactttttccagggttataaacgttacggcatccgctgaaaaaaaccgatttttacgcctccaaccgaaaccgcctgttgatgaattcctggaaatcatgaaatgtgaaacagggtttcaaaatctttcttttggtgccaatttttatcagcggtggcaaaatcaagaaggttataatttcaccatgcaattacattcccggtaaattattacaattgcgagggaattatgaagcaacctggttttatacgtctggctacgttggccttactctccacactctctttcttctcccacggcgaaaccattttgcgcctggcctacgctgaaaatagccagccggtaaaagatgcgttgcacttcctggggcagcaagttgaagagaaaacgggcggcgatatcaaagtacagtacttcccggacggacagcttggcggcgagcgcgaactggtggagttgacgcaggtcggcgtcgtcgacatcactaaagtgtcgtccgggctgatggagagtttttcgcctgagtacggcgtgttctcacttccctacctgtttgccaccgtcgatgaatactaccgcgtaatggataacccacaggtgaggagcctgtttatcagtccaccgccgcacagggttttgtcggcgtaggctggtatgattccggcgcgcgtaatttttatatgagcaaagcgccggttaaacgcattgaggatttacgcgggaagaagatccgcgtcatgcagagtgagacggcgatccaaactctcaaactgctgggcgcttcgcccatcgccatgagccaggcggaggtctatacctcgttacaacaaggcattctcgacggcgcggaaaacaatgagttcgctctcaccatcgcccgccacggcgaagtcgcccgttattacacctacgatatgcacacccgcattcccgatatcctgctaatgagtaccctcacgctggaaaagctgacgccggaacagcagcgcatcgtcgaagccgccatcaaggcgtcgatcgaatttgagaaagccgcatgggacaaggaaatagagaaaaccaggctggcggcggtaaaagatttcaacgttgaattctacgagatcgacaaaaaacccttccagaaggcagtacagcctatttacgacggtctgaaaaacaaaccgcggctttacgggctgtatcaacgtatccagacagcaaaaaattaatctaatcaggaaattaagatgaacacattcagaaaaggacttgatttattgctgggcgctatctgttgcctggtgctggcgataatggttggcatcgcctgctggcaggtggtgagccgctacattctgggcgttcccagcacccttaccgaagagatgctgcgatttctcctggtgtgggtatcaatgctgggcatggcttttgtcgccggtcagaaacagcatatcagtctgactatcttactggataaggtgtcgccgacgattcgcggctggtgggatatcatcctgcaggtcatttttatcgcgttttccatttgggtattgattatcggcggcttaaagatttctgcgatttctatgctgcaaatctcccctgcgctgggcattccgatggggaaaatttattacgcgctcccctgcgcgggcatactgatcatcctctatgggctactgaatatcgttgacgccctgaaagctatccattccgccacggataccactgagcacactctggagaaatcacatgattgaccctatttttgcgtcctgtacgctaattgccgtctttgttgttttactggccatgggcgcgcctatcgggatctgcatcgttatcgcctctttcagcaccatgatgctggtactgcctttcgatatttcgatgttcgccaccgcgcaaaaaatgttctccagcctggacagttttgccttgctggccgtgccgttcttcgttttgtccggggtgatcatgaatagcgggggaattgccgcccgactggtcaattttgccaaactgtttactggcaaactgcccggctcgctctcttacaccaacatcgtcggcaatatgatgttcggtgcaatttccggatcggcgattgccgcctcaacctctatcggcggcgtgatggtgccgatgagcgcgcgcgaaggttacgatcgcggttttgcggccgcggtgaatatcgcctccgcgccgacgggaatgttaattccgcccaccacggcttttatcctttatgcgctggcaagcgggggaacatcgattgccgctctgttcgccggcggtctggtcgcgggagtgctgtggggcgttggctgtatgctggtcacgctggtggtcgctaagcgtcgaaattatcgggttttcttcaccgtccaaaaaggcatggcgctaaaagttgccgttgaggccattcccagcctgttactgatcgtgattattgtcggcggcattgtgcaggggattttcaccgccattgaagcctccgcgattgccgtggtgtatacgttattgctgacgatagtgttttaccgcacgctgaaaattaaggatttgccttcgattttgctccagacagtggtaatgaccggggtcatcatgttcctgctggcaacctcttcggcgatgtccttctcgatatcgatcaccaatattcctgcggcgctgagcgatatgatcctcggtatttccgccaataaactggttatcctgttagtcattaccgtctttttgttgattatcggcgcatttatggatatcggtccggccattctgatttttaccccgattctgctgccgattatgactaaactgggcgtcgatccggtgcatttcggcattatcatgatctataacctggcgataggcaccattacgccgccagttggcagtggtttatatgtcggggcgagcgtcggtaaggtcaaagttgaggacgttatcaaaccgttgatgcctttttacggcgcgattatcggcgttctgttattaattacctacattccggaaatcacactgtttttaccccgtctactgggcatcatgtaaggcatagtttcctgcacatctcgttgccggatggcgattcgcgtcttatccggccaacgcgcgataataattatccgcaggtcatcaccaggtaaaaaaaccggctacctataaagtagccggaaaagggaataaataataaacagggataatgattagaatgtgtagcctatacccacgcggaaacgggtttgtctttcatcgctgttgctattgacggaaacattacctacctcaacgaatggcgaccattggtcaataatataggcagttctgaagttatattcatagttatctttgccgccatcgtaaagatcatatttatcggctttcttataaattccttcgattgtccagtcaaagttgttccatttataacccgcccagacatccatacgattgatggtatcatcatcacggatatcagaagaacggcgtacatattcaaaacgatagcgcgcgccaacccaccaactttcatttaatgtccacgtcgcgcggaagtaaggcttataggtagagtaaccgttgcctgtttccagcacaaaacccggttgccaggcgacatcaccggttttaaattggtagcttatcgtatattcgttaccctgtgtttccaggtcattaaacgctttattggtgtcatccccgcctgattttgagatagcttctatcgcaaaaccaacaccattcgcaaaccgatgagaaatatacgcacggtcatagttagctttactgtcatcaagatattcatgacgaacatcgacatatactgcatgcgcatttgttacaacaagaggtaatagtaagaaaagagattttctcataacagaatccatttaatttaaaattaaaacgttgtttcatgtcagaccgttacaaccataatacgcaatgtgaatggcgacaatataggcaaagatctttaatttaaaattgggataatgttcaaaaagcaaaataaaataaatgaaatttatattcgtcatataaaataaaaatcaaaactccatcaacaacgccaatatagggatttccttatatttatatttcattgattcctaacgttaatttcaatatatttaaattgtaaatacaaataaaacaactaaataattactgtataactacccttttatcaaacggtaagtcagactattcccattatgtgatctcacgcagcgttttctttgcattactgccagctaagtcgtttcgtgtcgttatgatgaaggtattttagaaaacaaatattacccactgatttaaataacatccagacggtcacgatgcgctccgacttttttaaaacgtgaagttaatcacttcattaacgtgctgattgccagaatacacccaacggcggcaatcgttataaggttaccaggctgcgtaatttttaaactcatgcaaacggaaggggtatcccgtccataaaaaataatgaggaacatgtcatgagtaacgcgattacgatgggtattttctggcatctgataggggcggccagggcaacctgcttctatgccccgttcaagcaagtgaaacagtggtcatgggaaaccatgtggtcagtgggcggcatcgtctcatggcttattctgccgtggacaattagcgctctgttactgcctgatttctgggcctattatgggcagtttaacctctccacccttttaccggtttttctgttcggcgccatgtggggcatcggcaatattaactacggcctgaccatgcgttatctcggcatgtcgatgggtatcggcatcgctatcggcattacgcttatcgtcggcacgctgatgacgcctatcatcaacggtaacttcgatgtattaatccataccgaagggggacacatgacgctacttggcgtttttgtcgcgctgatcggcgtcgggattgtgacgcgcgccggacagttaaaagaacgcaaaatgggcattaaagcggaggagttcaatctgaagaaagggcttctgctggcagtgatgtgcggtattttctcggcggggatgtcttttgccatgaacgccgcgaaaccgatgcatgaagctgctgccgcgcttggcgttgacccgctctatgtcgcgctgccgagttacgtggtgattatgggcggcggcgcgctggtgaacctcggtttctgttttatccgcctggcaaaagtgcaaaatctgtcgataaaagccgacttctcgctggcaaggccattgattatcagcaatattctgctgtccgcgcttggcggtctgatgtggtatttgcagttctttttctatgcctggggtcacgcgcgcattcccgcgcaatatgactacatgagctggatgctgcacatgagcttctatgtgctgtgcggggggcttgtcggtctggtgctaaaagagtggaaaaatgctggccgccgtcccgttgccgtattaagcctcggctgcgtggtaattattatcgcggcgaatattgtcggtttaggcatggccagttaatcgctttgattactgagatggcgccattggctcggcgtcatcccggtttcccgcgtgaacaccactgaaaaataattactatcttcaaagccacactgcatcgaaatctcgctaaccatcagcgggctatgctgaagcagatactgcgcgtggcaaatacggacctggcgtaaatattgattaatcgtcatcccggtttgggcgcgaaactgctgccgcagcacccgctcgctgcattgttcctgctggcaaaacgcatccagcgcaaagggacactcaaggctattagccaaagcggtaattaatttatccaacagggtttctcgggaggttgccggaagatcgtcggtcgcgtagcgatgccgttttaacgtcattaccagttgaccaaacagcaattccgccatctcattcgccagcggatcgcgtccattactctcatgttcaagctggttaatgacctgccgcgcctgattcattcccatactgcccagccgccagtgaggatgccactgcgctccctgaaagccgggaatcatcgcctgccagtttacattgagtttcaaacgctccgggcagtaaataatattttgcagcaccagatcgttaacggaagtataggagtgtttgtcttcagcacgaatgtaaaacagatcgccgcgggtaattctgtatgggcgctcattaagaacgtgtaggccattgccccgccagaccatcaccagttcacaaaactcatgcgtatgttccgcaaaaacatcctgtggatagcgatcggcaaccgtaacggcctgctgctcatcagtaaaaaaatcttttttcaaaaggattaactgatttgccaccgcagcacctcatgttgaatgcttgccggctggcgctacgcttattctgtctaccgctcgccgccgtaggccaggtaaggcgcagccgccatccggtattaaagggtataattatcagcatattggcgacgaaaacgttgatagcgttcgcgttactggattatcgcatcgcgtccctgacggatatcccgcggcgaccagttaaattctcggcgaaacagagtcgaaaagtggttactgtcgccaaaaccgcagcggtacgcgatttctgtcacgctatgatcgctatggcgcaataaatgccgggctttgatcaaacgcaggcgattaaggtaacgttgcggcgtcagcccggtatgctgtttaagctgacgatgcagcgtacgtagcgacagcgaaaactgttcagctaccgcctcccagcagacctcctccgcaaaatggtcttccagccatgccatcagttggttgagtttggcgtcgttattggtcgcgccttccatcaggctactgcggcgtaacaacaccagtagttgcataaacaaaatttcgcgattcgccacggcaggcgcatccatgccgtctccggcgcgctccatcagaccgaccaactggcgcacctgctgcaacacactctgattcacccgccagtgagaaggatagtaaccatcctgctcctgcggcagcaattgatccaaccccgccaggaactggaaggcgtccggtgaacgccacagtacattcgtcaggcataggttgtcggtatgttcatataaatgccggtcgtgatcgcgaacaaaacacacggtaccgccgctgatggtatacggctgcccgttgaatacatgaatgcccgtaccgtgttccacaatcacgatttcatgaaaatcatgatgatgttcagggaaagcggcttgcggcagacgaggttcaatcgccacgggcgctttacctgatggaaaaaaatccacgctatgcagtacggtcatggttgcttcctcctgaattcaacatgtccgaatagtaattaagggttatcggcctcaccttaaatttttgacgctaaagcgcgcaaacatggtctttttttcaagaaaaggcgggaaaaagcgggaaatgcggacgacatcacaccggcctattagtagaaactgtgaacgctatcacgttcatctttgccttgttgccagcggctcattttcctgtcagtaacgagaaggtaggtctttgagggcttttttagactgtgcgcaatgactctaagaaggacctgattatgacttttcgccattgtgtcgcggttgatctcggcgcatccagcgggcgcgtgatgctggcgcgttacgacagcaaacaccgtaccctgacgctacgtgaaattcaccgttttgtgaactgcctacaaaaaacagacgggtttgacacctgggacatcgacagtctggaaaaggatatccgtcttggtctgaagaaagtctgcaatgaaggcattcttatcgacagcatcggcatcgacacctggggcgtcgattatgtcctgctggataaacaaggtcagcgtgtcggcctgccggtctcctaccgcgataaccgtaccacgggcatcatgccgcaagcgctggtccagatcggcaaaagcgaaatctatcgccgcagcgggattcagtttctgccgtttaacaccatctatcagctacgcgcgctgacgaaacaacagcctgagttaacggcgcaggtcgctcatgcgctgctgatgcctgattatttcagctaccgcctgaccggtgaaatgaactgggagtacaccaacgccacgaccacccagttggtcaatatcaataccgatgactgggacgataccctgctggcgtggaccggcgcgaaaaagagctggttcggccgcccctcgcaccctggcaatgttatcggcgactggatttgcccgcagggcaaccgtattccggtggtagccgtcgccagccacgataccgccagcgccgttattgcctctccgctggcaaataaacatagcgcttacctgtcttcaggcacctggtcgttgatgggttttgaaagcaaaaaaccctacaccactgatgaggcgctggccgccaatatcaccaacgaaggcggcgcggaagggcgttatcgggtactgaaaaacattatgggtttgtggctgctccagcgcgtgctgaaagaacggcgcattaccgatctgcctgtgcttatcgcccaaacagaagcgctgccggcctgccgtttcctgattaacccgaatgacgatcgctttatcaatcctgacgatatgcgcgccgaaatccaagccgcctgtcgcgagaccgaccagcccgttcccgtcagcgatgccgaactggcgcgctgcattttcgacagtctggcgctgttgtatgccgacattctgcacgaactggcaaatctgcgcggcgaaaaatttacccaactgcatattgtcggcggcggatgccaaaacgcgctactcaaccagttgtgcgccaatgcatgtggcattcgcgtgatggccgggccggttgaagcctccacccttggcaatattggtattcagcttatgaccctcgacgaattaaacaacgtcgatgatttccgtcaggtcgtcagcgctaactacgacctgacaacctatatccctaatcctgatagtgaaattgcccgccacgttgcgcagtttcaacccaaacgacagacaaaggagctttgcgcatgaccactcaactggaacaagcctgggaactggcaaaacaacgtttcgccgcagtaggtattgatgtcgaggaggcgctgcgccagctcgatcgcctgccggtttccatgcactgctggcagggcgacgatgttgccggattcgagaacccggaaggttcgctgacgggcggaattcaatcgaccggcaactatccgggcaaagcgcgtaacgccaccgaactgcgcgccgatctggaacagacgctgcgtctgatcccaggccccaaacgtctgaacctgcatgcgatctatctggaatccgatacgccggttgcccgcgaccaaatcaaaccggagcattttaaaaactgggtggagtgggcgaaagcgaaccgactggggctggatttcaaccccacctgtttttctcatccactgagcgctgacggttttaccctctctcatccagacgcgaaaattcgccagttctggatcgatcactgcaaagccagccgccgcgtctcggcatactttggtgagcagctcggtacgccgtcggtgatgaacatctggattccggacggcatgaaagacattaccgtcgaccgtttagccccgcgccagcgcctgctggaagcgctggatgaggtcattagcgagaaattcgacccggcgcaccacatcgacgccgttgagagcaaactgtttggcatcggcgcggaaagctacaccgtcggctccaatgagttctacatgggctacgccaccagccgtcagaccgcgctgtgtctggatgcgggccacttccatcccactgaagtgatttccgacaaaatttccgccgccatgctctatgtgccacggctgctgctgcacgtcagccgcccggtacgctgggatagcgaccacgtggtgctcttggacgatgaaacccaggcaattgccagcgagatcgtccgtcataacctgttcgaccgtgtgcatatcggcctggatttcttcgacgcctctatcaaccgtgtcgccgcgtgggttatcggtacccgcaacatgaaaaaagcgctactgcgcgctctgctggaacccacagatcaactgcgtcagcttgaggccagcggcgattacaccgcgcgtctggcgatgctggaagagcaaaaatctctgccgtggcaggccgtctgggaaatgtattgccagcgtcacgacacgccggctggcagccagtggctggacagcgttcgcacctacgaaaaagagatcctgagcaaacgtagctgacagcgacacctgatctgtaggccggataaccttcgggcaataaatgggaacacgaatatgcaaaatattaccgattcctggtttgtccagggcatgattaaagccacgtctgatgcgtggctgaaagggtgggacgagcgtaatggtggcaacctgacgctgcgcctggatgaagcagacatcgcgccatttagcgccgatttccacgaaaaaccacgctatatcacgctaagtcaactcatgccgctgctggcgaatacaccgtttatcgttaccggctccggcaaattcttccgcaacgttcagctcgatccggcagccaatttaggcgtggtcaaaatcgacagcgacggcgctggctaccacattctgtggggcttaacccacgacgcggtacccacctctgaactcccggcgcacttcctctcccactgcgaacgcatcaaagccacccacggcaaagaccgcgtcattatgcattgccatgcgactaacctgatcgccctcacctacgtactggaaaacaacactgcgctgatcacccgcaaactgtgggaaggcagcaccgaatgcctggtggtattcccggacggtgtcggcattctgccgtggatggtgccaggcccgatgaaatcggccaagccaccgcgcaagaaatgcagaaacattcgctggtactgtggccgttccacggcgtgttcggaagcggacctacgctgaatgaaaccttcggtttgatagataccgcagagaaatccgctgaggtattagtcaaaatctattcgatgggcggtatgaagcagaccatcacgcgcgaagaactggtcgcactcggcaaacgatttggcgtgacaccgctggccagcgccgtagagctgtactgatacctcccaactcaacgccggatgcggctttgccttatccggcctacaggtcggtgcgcattttaccgtaggcccgataagcgtagcgccatcgggcaacagggaatttttttaaggagaatagtgatgagctttatgttggcactgccaaaaattagcctgcatggcgctggagcgattgccgatatggtgaacctcgtggcgaataagcaatggggcaaagcgctgatcgttaccgatggtcaactggtaaagctgggcctgctggatagcctgtttagcgcactggatgaacatcaaatgtcttaccacctgtttgatgaggtgttcccaaacccgacagaagagctggtgcagaaaggttttgcggcgtatcagagcgcagaatgtgactacattatcgccttcggcggcggcagcccgatcgataccgcaaaagcggtgaaaattctgaccgccaacccaggtccatctaccgcctactccggcgtcggcaaagtgaaaaacgccggcgtaccgctggtagcgattaacactacggcaggtaccgcggcagagatgaccagcaacgcggtgattatcgactctgcccgtaaggtcaaagaggtgatcatcgacccgaatatcatcccggatattgccgtggatgacgccagcgtcatgctggaaatcccggcgtctgtgaccgccgcaaccgacatggatgccctgacccatgcggtggaagcctatgtctccgttggcgcgcatccgctcaccgacgctaacgcgctggaagcgattcgcttaatcaatgtgtggctaccgaaagcggttgacgatggtcataacctcgaagcccgtgagcaaatggcattcggccagtacctggcgggtatggcgttcaacagcgccggtttggggctggttcacgcgctggcgcaccagccgggcgcaacccacaacctgccgcacggcgtctgcaacgctatcctgctgccaattgtcgagaactttaaccgtccgaacgccgtcgcgcgttttgcccgcatcgcacaggcgatgggcgtggagacgcgcggtatgtctgacgaagtcgcaagtcaggaagcgattaacgctatccgtacgctgagcaaacgcgtcggcattccagaaggtttcagcaagctgggcgtcacaaaagaagatatcgaaggctggctggataaagccctcgccgacccgtgcgcgccgtgtaacccgcgcaccgccagccgcgatgaagttcgcgagctgtacctggaggcgttatgatccgcaaagcctttgtgatgcaggtaaatgccgacgcgcacgaggagtatcagcgtcgtcataacccaatctggccggagctggaagccgtattaaaatctcacggcgcgcatcactacgcgatttatctcgatcaggagcgcaatctgctgttcgccaccgttgagattgaatccgaggagcgctggaacgccgttgccagcaccgacgtttgccagcgttggtggaaacatatgcgtgacgttatgcccgcgaatccggataacagcccggtcagcgcagagctaaaagaggtgttctatctgcagtaagtcgtgtgcccgatggcgcaagcttaccgggcctacggttttattttttgtcggccggataagacggttacgccgccatccggcaatttcaattctgctccgctaccaggatagcctgagtatccggttccagcgctttaaagatatgcgcctggtcgccgggataacaaatgtaatcgccctccgccagctcttccggcgcctcggttaagccgacgagggcttttccctgcgtaacaataatatgttccaccgaccccggcggatgcggatgagagatccggtcggcccccggctgcgtcaacagcagatagatatcacgccgcgcgccgggcggacacgccgccagtaatatcgcctgataatgcgcctgctccgccacgactttggtgccttctccgcggcgaatcacctgcgttttttgtacctgcggctccagcagcctggcaaagggaatgtcgagcgcgacgcatagcgaccatagcgtctccaggctggggttgccgttccctgcttccagttgtgaaagcgtagatttagcgatgcctgcgcgccgcgcaatctccgccagcgacagtccggtttgctggcgttcgcgtaccaggcttctggcaatgacgctaataggttgtgtcataaagcatccaacgttcactataacgaacgaaatgttcgtcttgtaaagcaaatctgttccgttcattataatgaaaattcgttcgatatgactaaagaagatgaaacactatttttcctgtctcaagggagacacgataaaagcgatatttttagtgtgcctggccgtgggcgtcgtcggcatgtcctatggctcactggcgatggcctacggtttcccactgtgggtgccgtttgtcctctctatttttgtgctggcgggcgcgtccgaatttatgtttatcggcattgttgccagcggcggcaatccgttagcggcggcggcggcaggactactggtgaatgcgcgccacgtgccgtttggcgtaacggtgcgcgatttggttggcacccgcgccgccagctttttcggctgccatatcatgaatgatgagagcgtggtgttcggcctgtcgcaaaaaacacccgaacaacgtaaagccgcctactggctatgcggtctgggcgtcgccctattctggccgattggcacactgattggcgcaggtgtcggcaaactgctcccggccccagaaaccatcggtctggacgccgtattcccggcaatcttactggcgctggtgatcccggcgtttaaaaaccgcaccacattgattcgtggttgcagcggcgccgcgctgtcgcttgccgccgttccctttgtggctgccggattgccggtgttgctttcgctgcttggcctactggcgaggaaaaaataatgggcaatatgacgctatttattatcggtattgctcttttatctacgggaacctatttgatgcgcctcggcggcgcgaaacttggcagccgtctggcgctgtctgagcgttcacaggcgctgctctcggatgcggcaacggtgctgctattctccgtcgcgctggcgaccaccttttacgaaggcgaacattttgccggaatggcgcgcgttcttggggttggcttcgccgtatttttagcctgacgtaaaatgccgcttattgtggtgattatcgccgctgcagtggtgaccgcgttattacgaatggcgggtattaattaacgtcttacagaacagttggacgtgacaccctataagtgatgaaggctgggccgccctatgctgaagtggctcagaattttcgcatcagggggataaatgttttccatatgaatgccgattctcaattacactatcagagtaacttcaacatcttgtgatagcttcagattactggttttcctaatagctctccttagttaaggtttacgtcagctatttttacggatattgcctgacgaaatgcatgaacgaaaaaagcgcctgatcggcgctctttattggtgttatagcgtaactttataggcgcttacgccagcctgcacgcagttaatgtgccgtcactcaacgcaggcggttataatcatccaccatctcgttataacttctcaacgacgccggataagaatccgcaaccatccatcctgttgcagggtcctgcacccgtttcttttcaaaatcagaatactcaacattgtctctgatgcgacgaatatattttttagcttgtagctgataatcagccgcagagctgatgaaagaagaattacggccatcagtattcacttctttcaattgcgcaatcattgtttccagttccgcgacttttttcatcatcgcttcggcatcaaaggtatcggcagaaataaccttgttgatctgctttgccgaaatcatgacagccagagaataatagttaaatgttttaccttccgcttcttctattttcttcaactgtgtcaattgccgcttgtcatttatttcctgaatagcctcatgatatttttccgagataggtttaaaatcctcgatattcttcagtaatgtctgatgcagcgccttacctttagcaaaaccatcatctttatagttttcctgggtataatatttttccatttcgttaatggtattacccagcgcggcggcgctatcaatatagctaacggcaacgccatcaataggctcaagcaatggcgttaaggcggccacctgtttcatctctttctggcaattcgttatgtaagactccgtaataccataaatgccataaaccaggctctctttccctgtcggaccttttttaaagtctttcacccaatccgcgtaacgcgccagactgtgctgaacgggcaattgaagtttattaaaacaatcgatatagacatccattttttcactataaacttcttcagcgtcaacctccggctgagctggcgtttctggcttcgccgccgggggctgagttgctgtttctggcttcgctgctgggggctgcgctggactttcgccagattgcgtttccggcgtctgagaaggcgctggcgtcgcaggctgactgctggcggccggcgtcgcctcggttttaacattattgtcatcacatcctgttgcgcccagggtcattagcgcaatgattatcgctgaggataataaattccttttcatttaattgccttttgtatatttacgttggggttctcttattttaacgaacacattgatattgataatgttaattataatgaaatatggattaagtattttttgtgttgaataaatcacatacctgtttttttcattaaaatgaatctgtaaatttcaatgatattatttataggttattctaatgaaaaaggatttgttatcatcaattattatcgctatgctgatgactgccgggctaagcgcttgtgatgaaaaaaaagcggacgaacaacctgtagctcagagtgcggattcatcagcgagcaatacacaatccacatcagcggaaagcgcagatgcgaacgatgttcttaaccaaaagctgaatgtttacattgattgttataataatctccaggcagatatttaccgtgctgtaaatcgttatgctaacacattcgacgatttccgcaccggtcctaccggtaaggaagacgatccctctccgctggttcctgtgtatcctgcatttatccaggactgccggaaagacatcaaggcggcggctgaattaaagccggcgtttgcctctctggatagtgctgctctggcatttattaatgcggctgggccactagctgaaacaatcaatagtatgaataaatactatgatcaagataacttcaaggatgatgcctttgctggcgctaaagcgttccataaaacgtttataaaacagttcgatgagtttgatcccattgcgaaaaaatatatcgccgagattaccattatgagtaagcagcatgcggctaatgaaattaaggcgaccgagaagaaagaaggtaaatccattaagtactatacgcttttgacgatgcaggaagccgagacgcttaatgacgctgtagctgatgcttcttttgatgtggcggcagtaagcaaacagctcgctgattttgaagagcatactcagaagctaaacgagaagatcaacgttgatatagataaacatcgtagcttccctggttttatttctgagctggaaaaattccagggcaaggtgaaaaaacgcattcggcgcgtgcgcgataacgtggcgtatacctcgcatgagcaggactacctcaatagcggcagcggcgatatggtagatggttcttataaggctgtggttaaagcttataacgagctcatcgacacctataatggctatcatcttgagcgtgagttctaagcttttcacgctgcaaatcgcgtgcatatgaccgctgaactgagcaaataagtcgttaccgactgtcgaaagagcgccccaggggcgcttttttcgttcgaagtattaccgggtagcaagcgcctcgttaatgactggaataagctgcggtccagcttaaaaacgattaaaacctgtatggcctcgccactatacgtgtatacgtgattccgttatcaagagaggctgtaaaattgagaaaatatatattttacgaaaatgtagagggtactattttagtctgcgattaaccgctgcggatgggtataaatcgtcgcccgacccggcttacagaaccccaccagcgtaagattacaccgttcagcgacgtcaaccgcgagcgtggtagcagcagaaaccgcaaacaaaatttccacaccgcacatcgccgacttctgcaccatttcgtaactcgcacgactgaaaaccagcgccgcgccttgccgccattcctcaccttccgtagcgcggcggccgagcagtttatccagcgcaacgtggcgtccgacatcttcatggccccccgccagttcacccgacggcatgacccacgccgcagcgtgcgtacaacccgtcagcttacccgtcggttgaaaatcattcagatgttttaacgcgcgatcaaggttaccgagattaaacgtttggctaaacggcagcggttgcaccggcttaccaatgtcattgagctgttccacgccacacacgccgcaaccggtgcgtccggccagcgcgcgacgacgcgctttcagccccataaatcgacggctggaaagatcaatctgcacttcaagtccgttacaggacggcacaacgtccatgccatagatttcacgcgggctgtcaatgatcccttccgacagagaaaaccccattgcgaaatgcgtcagatctttcggagaggccatcataacgacatgcgaaatgccgttatacaccagtgccactggcacttcctcggcaacatcatcaagttgggaggactgcaaatcctcgcgtttccagagtgtcaactggcgtgaggttgtgaaatcagtcacatttaggacttcttcagacagtatattgttcactttcttttaaccatataagaacacacacaccaacattatggtattctgttacaactcctcccggatggaggaaaatttatccaattctgaacctttgcgggcccgtccgcaaagaaaaataacaaccactccctgagcgtttcagatagagaaatgtgaaagagaagtgacaatgtcgaaacaaggagcaaaccatgcaggtcagcagaaggcagttctttaagatctgcgctggcggtatggcaggcaccacggcggcggcactgggcttcgcgcccggcgtagcgctagcggaaacacggcaatataaactgctgcgcacccgcgaaacccgtaacacctgcacctactgttccgttggctgcgggctgttgatgtacagcctcggcgacggtgcgaaaaacgccaaagcatctattttccatatcgaaggggacccggatcatccggtaagccgtggcgcgctgtgcccgaaaggggccggtctggtggactttatccactctgaaagccgcctgaaattcccgcaataccgcgcgccgggttcagataagtggcaacagatcagttgggaagaagcgtttgaccgcatcgctaaactgatgaaggaagatcgcgacgccaactatcaggcgcagaacgccgaaggcgttaccgttaaccgctggctcaccaccgggatgctgtgcgcttccgcatccagtaacgagacgggttatttaacgcaaaaattctcccgcgcgctgggtatgctcgcggtcgacaaccaggcgcgtgtctgacacggaccaacggtagcaagtcttgctccaacatttggtcgcggtgcgatgaccaaccactgggtcgacatcaagaacgccaacctcgtcgtggtgatgggcggtaacgccgcagaagctcacccggtcgggttccgctgggcgatggaagccaaaattcacaacggcgcgaagctgattgtgatcgatccgcgcttcacgcgtaccgcgtcggtggccgatttttatgcgccaatacgctctggtactgacattgccttcttgtcaggcgtgatgctgtatctgctgaccaacgaaaaatacaaccgtgaatacaccgaggcctataccaatgccagcctgatcgtgcgtgaagattttggcttcgatgatggtctgttcaccggctatgacgcagacaagcggcagtacgataaaaccagttggcactatgagctggacgaaaacggttttgccaaacgcgatacgacactgcaacacccgcgctgtgtctggaatctgttgaaacagcatgtctcacgctatacgccggacgtggtagaaaatatctgcggtacgccgaaagcggacttcctgaaagtgtgcgagtacattgcagaaaccagcgcaaaagataaaaccgcgtcgttcctgtacgcgctgggctggacgcagcattccatcggcgcgcagaacatccgtactatggcgatgatccagcttctgctcggtaacatggggatggcgggcggcggcgttaacgccctgcgcggtcactccaacattcagggactgaccgacttaggactgctgtcgcaaagtctgccgggctatctgacgctgccgagcgaaaaacagaccgacctgcaaacctatctggctgccaatacgccgaagccattgttgaaggatcaggtcaactactggggcaactatccgaaattcttcgtctcgatgatgaaggccttctttggtgataaagcgacagcggaaaatagctggggcttcgactggctaccgaagtgggacaaagggtacgatgtactgcagtacttcgagatgatgaaacagggcaaggtcaacggctatatctgccagggctttaacccggtggcttcattcccgaacaaaaacaaagtggtcgcgtcgctttccaaactgaagtacctagtgactatcgatccgctcaacacggagacctccaccttctggcaaaaccacggtgagtcgaacgatgttgatccgtcaaaaatccagaccgaagtgttccgtctgccttccacctgttttgccgaagagaatggttcgatcgtcaactcgggtcgctggctgcagtggcactggaagggcgcggacgccccgggaattgccatgaccgacggcgaaatcctcgccggtatcttcttacgcctgcgtaagatgtactctgaacagggcggcgccaacccggaacaggtgttgaatatgacctggaactacaccaaaccgtacgaacccgcctctgaagaagtggcgatggaaagtaatggtaaagcgctggccgatcttatcgacccggcaaccggcgcggtggtagtgaagaaaggtcaacagctcagttcgttcgcgcaactgcgtgatgacggtacgacgtccagcggctgctggattttcgccggtagctggacgccggaaggcaacatgatggcgcgtcgtgataacgccgacccgtctggtctcggcaacacgctgggctgggcatgggcatggccgcttaaccgccgtattctgtataaccgcgcttccgccgatccgcagggtaacccctgggacccgaaacgtcagctactgaaatgggaaggcggaaaatgggccggatgggatattccggactacagtgccgctgcgccaggcagcgacgtcggaccgtttatcatgcagccggaagggatgggtcgcctgtttgctatcgataagatggcggaagggccgttcccggaacactacgagccgtttgaaacgccgctgggcactaacccgctgcacccgaacgttatctctaaccctgccgcccgtatctttaaagacgatgccgacgcgctgggtaaagcggataagttcccgtatgtcggaaccacttaccgtctgaccgagcacttccactactggaccaagcacgcgttgcttaacgctatcgcccagccggaacagtttgtggaaattggcgagaagctggcgaataagctcggtatcgcgcatggcgataccgtgaaggtctcctcgaaccgcggctatatcaaagccaaagcggtggtgaccaagcgtattcgcacgctgaaagcggacggcaaggatatcgataccatcggtattcctattcactggggctacgaaggcgtggcgaaaaaaggttttatagccaatacgttaacgcctttcgtcggcgatgcgaacacgcaaacgccggagtttaaatccttccttgtgaacgtggaaaaggtgtaacggagacgacctatggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaactgcgaaatcctggacggtgatgcgcttctcggaagtggaacagaacgacaaactggagtggctgatccgtaaggatggctgtatgcactgcgccgatcccggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgactgtgtggtggtcggccaggaaccggcctgcgtgaagacctgtccaaccggcgctattcattttggctcgaaagagaatatgaaaacgctggcgggcgagcgggtggcggaactcaaaacccgtggttatgacaatgcgggtctgtacgatccggcgggcgtaggcggtacgcatgtcatgtacgtgctgcatcatgccgacaagccgaatctgtatcacggtctgccggagaacccggaaatcagcgaaaccgttaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatgaaacgacgtgacaccatcgtgcgctatacggcgccggaacgcatcaaccactggatcgtcgccttctgcttcgtgctggcggcggtgagtgggctgggctttttattcccatccttcaactggttgatgcatatcctgggcaccccacaactggcgcgaattctgcacccgtttgtgagcgtggttatgtttgcctcgttcatcatcatgtttttccgttattggcaccacaatctaatcaatcgggatgatatcttttgggcaaagaatattcgtaagatcgtcgtcaacgaggaagtgggtgacaccgggcgttataacttcggtcagaaatgcgtattctgggcggcgattatcttcctggtgctgctgctggtgagcggggtaattatctggcgtccgtactttgcgcctgctttctcaatcccggtgatccgattcgcgttaatgttgcattcttttgccgcagtagcgttaattgtggttatcatggtgcatatctacgccgccctttgggtgaaaggcaccattaccgcgatggtggaaggctgggtaacccggtcgtgggcgaagaaacatcacccacgctggtaccgagaagtccgcaagacaacggaaaaagaaactgaatgagtattcgcataatcccgcaagatgagctggggtcgagcgagaaacgtacggcggatatgattccgccgttattgttcccccgactcaaaaacgtctacaaccgccgcgccgaacgtctgcgcgagctggctgaaaataacccgctgggcgattacctgcgctttgccgcgcttatcgcgcacgcgcaggaagtggtgctgtacgaccatccgctggagatggatctgaccgcacgcattaaagaagcgaacgaccagggcaagccgccgctggatatccacgtgctgccgcgtgataagcactggcaaaaactgctgcattcgttaattgccgagctaaaacccgagatgaacggccccgcgctggcggtgattgagaacctggagaaagcctcagagcaggagctagagcagatggccagcgcgctgtttgcctcggattttgcctccgtcagcagcgataaagccccgtttatctgggccgcgctctccctttactgggcgcaaatggccagcttgattccaggcaaagcccgcgcggaatacggtgaagcgcgccagtattgcccggtatgcggttcgatgccggtctccagcatggtgcaaatcggcaccacgcaggggctgcgttatctgcactgtaacctgtgcgaaaccgaatggcacgtcgtgcgcgtaaaatgcagtaactgcgaacagagccgcgacttacactactggtcgctggaaaatgagcaggctgcggtgaaagccgaaagctgcggcgattgcgggacttacctgaagattctctatcaggaaaaagacccgaaagtggaagcagtggccgacgacctcgcctcgctggtgctggacgcgcgcatggaacaggagggcttcgcccgaagctctatcaacccgttcctgttcccgggggaaggggaataagttttttactcagaccgggcgaagtttgccgtccggtctacaagtgatacggcgtgatcactcccggaatatcggcaaagtcttttgtattgcgcgtcacaagctcacaacgatggacttgtgcagtggccagaatgatcgcatccgggagtttcatgccatactcctgcctgacaatgacgcttcgttccgcgatttcctgtgttacgccaataatattgaacgcacttaatgcaatgcgcgtgcggttttcctgatgatatttcttagcacccaccatcacttccatccatgtgataaggctaatcgcattttgtggcggatacgcttccagcgcatgtttcgcttcaattcgaccgctaaacaggtcgatgaggatattggtatcaaaaagcgcagaccctttgaccattaccattcctcacgaagtttacgttggtattcaacgccatcttcctcacagccttgccagagccccaatgctttcgaaattgtggtctcagcccgatcctgtctttccagatactgctcaacggcctcccgcaagagttctgcacgaggtaggttgcgttgcaccttgagatcgtcaagccgtttaatcacatcgtctgataaatcgagtaaaattctgcccatatccatcccagccatcatactcacatatacctccagtatatcattcgcgcttatttttcaaacaacatacacctgagactgacgagaaaatagttattacgcgaacgatttttatttttgcgagccgctttccagaatcgtacgcagcccaattttcccattttcattcgaaccaaatcgagttataaaactgtatatccatacagataaaggcaatgaaaaatggcactggaaagcgggattgcgcagttagtggaggaatttatcgcggcgggacgcccctcttctcgcgaacagaatattgatgaccggagggcgggctacatcgctagcacgacattggcaggagaaacagaaacccgcgtccaggttgaagatattgaactcgatgccatgacgtttcgcgtggtttcgccgctcaatgccacagggaaattaccctgcatcatttattatcatggtggctgctttgtcagcggcggttttgccactcacgataaccagttaaggcagttagctttttacagccgttgtcgcgtgattgcggcacagtaccgacttgcaccagagcacaccttcccggccgcacataacgatgccgaaaccggagccaatactatctggaaatatgcccagaaactggggatagatcgcgagaacattacgcttgctggtgacagcgcgggtgggcatctggcgctggtcaccgcgctacgcctgaaagccgcccgtcaatggcaacctgcacagctgattctgatctaccccatgctggacgcaaccgccaggtttgcgagctacacctgtaatgggctggattacattatcacgcgtgacacgctgctttcaggctacgagatgtatatgccgcgaaccgatccactgcatcctgaagccagtccgctctggcgtgaggacttcgccggtctgccatccacgcacatcattactgccgaattcgacccactgcgcgatgagggcgaggccctgtatcaacggttccaggaacagggtgtggaatgcacttgccagcgctatctcggcgttatccacgggtttttccaattgggcggagtgagcaagacggcgcgggacgcaatacgcgacgtggcctggcgtgttgtaagtccatcaacaagcaaaatgacctaaaattcaattttgttttcaacttgaaaactggataacgttgcgctaaattgttttcaggttgaaaactttgtaatggaactacattgtgcatgttatcagccgaaaactgttcaatgaagcgatgctcatgtatccaaaccatgagcttgctctcactgagttgctgaatgttctggagaaaaaaacattcactcagcctgaagagatgaagcggtatattccttcgctggataattttaagtacagagataaatggtgggtgattgatgtttctggtaacagcctgagactcatttcctacatagatttcaggttacataagatatttgtgaaacatatcgtttcccatgccgaatatgacaaactgaccgcatattatcggggtaatgaagaatgagaactcatcgtcagatggatgcaaccagcgcaaaaaagatcgttgataccttcagcgatgcggtaaaaagcgtcccactgatgggggaagaccgaaatgacaatgagtatcgcagggcactagcgctagtggagtttctggtcgaccacgacgatcttgaaaacccactatttgaattgctctgtgcccgaatcagtgaatacgaaaaacatgcgccggaattcaaagcactcaaccaacacctggagaaaacgccccctggcgtttcagtattgcgaacgctcatggatcaatacggtctcaaagcagcagatcttgccaacgaacttggttctaaatcgaacgtcagcaacatcttaaatggccgcagagcactaacggttaatcatattaaagcgcttacacaacgctttaaactaccagcggatgccttcatcgagtagttggatatgtccagctactcttcctcattcccgccctcttcatacgggccgaacggtttcgcaggtagtacgatataaatgccttcgaaaattgccccggcggtctcgccgcccaacagttcaacctgcaactggacacgcgcttttttaccccgcgccagcctgtccaaatcaccgcttagcgaccccaaatcagccacggcgtttggctttccgctaatgggtttactgtagcgaatatgggcgtcagcaagaataatcgtcccgcccaggtggcgttcacggagcatcagccagataagtccccatccggtcagcgtcgccagggagaacaggctgccggcaaacaccgtgtgatgcggattttgattaccggtttccggcatcgtggtgataaatttttgcccggtgtactgctgaatgcgcacccccatcttttcactcaatggaatgtgctcataccaggcctgctgaagctgcccgcaccaatcgccgcgatgcaggatatcatccagcgatgctaccggtttaatcatcagaaaatggcggattggcgtggttgtgggcgtagtaatctccccctgattgacaaacccgagtttggcaaagaactcaaccgcatcttcgcgcgcgctgcaggtgacgcgcttaacgccttcctggcgggcgacagactccagggtcatcgccattaatgtccccagccctttatcctgtaccgagggatgtacagccataaaacggatagacgcctcgttatctgcattgatatacaggcggcccactgcaactaagtttccttcttcgtccaccaccatttgatggtgcgccaacgcatcccagccatcccgttccgaccctttcggctggtgcagcggtttacgcagcatctcccagcgaaactggtagtaacgttctaattcttcttctgtttgcggaactcgaaggtgatacatagccgtactctctcttgttatccgcggccacgccggaagctgactcatacctggagccagaatgtcacgggaccgtcattaaccagctcaacctgcatatcggcagcgaagcgtccggtttgcgtgtttatcgcctgctggcggcagcgttcgacaaaatattcataaagcgcctgcgcgcgatccggcgcagccccgccggaaaagcttggccgcataccgcgttcggtatctgccgccagcgtaaactgcgacaccaccagcacgctgccgccagcctgttgtacattcagattcatcttgccgtcaacatcgctgaagatacggtatcccagcacgcgctcgcacagacgattcgctttttgttcgtcatcttctttttcgacacccaataacaccaaaagtcctgggccgattttacccgtcacctcgtcctccacggtgacgctggcacgggttacgcgttgaattaatgcaatcatggttggtcagcttcttcttgttctgcggcttgtttgagttttcggtattccccgagagtgacagttatttctgcgccaagcaagactatacaccaggtccagtatacccagacaaacaggatagggatcactgccagtacgccataaatgagctgatatgacgggaacatggtgatataaagcgcgaaacctttctttccggcctcgaacagcaacgctgcgacaaacgcgccgacaagggcgtcacggttcggtacgcgagttgttgggacaatactgtaaagtaaccagaatgagatccacgagagcagcagcggaaggatgcgcaatacattgtcgatgaccgtattcagatcgctggcccagcgtaaagaaagcagataggagctgatcgccagactggcaccggcgagaagcgggccgagcgtgaggatcatccagtacaccgcaaaagagtacacttttgggcgtgtgcgtttgctgcgccagatagtgtttaaggcgctatcaatggcgtacatcaacagcaatgccgtcacaatcagtccacaggcgcccaccgccgtcattttgttggagttagcgacaaactgctcaatatagcgctgaatcacgtctccggtggctggcataaagttagcaaaaataaaatggcgtaactgaatgctgacatcagaaaacatcggaaaagcagcgaaaagggcaaaaacgacggcaataagcggtactaaggagagtaatgagacataggcgaggtttcccgccagagtcgtcatattatcctcatcgatacgctgccataatagcttgagccaggcccgaacagggcgcgtatggcgtccagctttttggtgaacggtttttagcataacagcttcgcgaaatagtcagggatggtggctttatccttcaccagaatgctggtgatccccaactggttggccccttctatattatcggcattgtcgtcgaaaaagaccgcatcggcagcggaaaaaccttctttctgcaggacgtgctgataaatacgcgcttccggtttacgcattcccaaatcctgcgataaatagatatggtcggcggcagcgcgcacctccgggtattcctccggccagaagtgggtatgcagtcggttagtattggataacaccaccacgcgatgcccctgctcgcgcagtttatgcatgatagcaatcacttcgggccgtaatccgacaaataccgcctgccagccgtgcgcaaattgttcataactgagcgataacgccatttcatgacagaaagcttcagcaaacgcttcgtccgttatctcaccgcgttcatgttggtgaaaagtctcgcccatcgtaaatttttgcttcagcgaagccaacggtactcgactcaggtcgctccacacacctaatacgcggttaaagtcgatatcgacaatcacattacctaaatcaaagatgtagagcatgtcattctccttgctaaccggggatgaataactgtagcgggaaaggagaagtttgactatgtatccctttataaatcaattaacaaaaagacaatagaaacgcagacgatgcccaatatcgcctgcatcacagcgccgttttattggccggataaagcgctgacgcgaccctccggcgcaagggcgcttgtcacgctgaaacggcgtcgtccagcgaaggactcacctgaaccacttcgatttgctgggattgaagtaaattctgtaatgccggaccgggatactcgtccgtaaacagagcggtaatctgtgacacattgccgatctcaaccgccgcaaaagcatggtatttcgtatgatcggcggccagcagaatatgtcgcgagtgagccatcatggttttcactacgctggcttcgttgacatcaaactccagtaacgcgccatcgctctctatcgcgcctacgctggtgacgagatagtccgcccggaaccccgccacaaacgccgccgcggatggcccgataatgccgctattatgcgggcgcagcgtgccgccaggcaccatcacttcaaagcgagggttattataaagaatgtgcgcgacgcgcaggctattggtgataatgcgcagatgattatggttgagcagcgcgcgcgccacctgctcaaccgtcgttccaatcgtgataaatatcgtggagccatccggaatatagtcagccacggcttccgcaatggcttttttctcttgcgtccaggagatctctcgctgctcaaaggcggtattgaccacactggacgctctgccagcgccgccgtgatgacgcgtaatcagcccctgctcgcttaatttacgaatatcgcggcgaaccgtctgggtagagacctccaacaaactggctaactcatcgatattcatatagccgcgctcatcaataagcattaacagccgatcgtgtcgcggattaccggtcagttcggtaagactcatgagcattcctctaaaagcttcctactgctcatattatacaaaaagtgacaagaaagatcgggtttgctcacaatcagggatacccgcccggccacccgggcgcgtacacttcagcgcggcaacgccgctggcgaatctgacagcctcttcgatagcgtatccgcttgccaggccaaatgccagtgcgccatgaaaaacatcgcccgcgccggtagtatccaccacctccacggtaaaacccggttggtggcgtaccgccgctttttccaaccagttgcagccttcgctgcctcgcgtgacatagacatgtccatttgtgagcatttgtgctttttttagcgcatcaatggcttcgctcatccccgtcaggcgtgccagccccggctcggagaaggcggcgtggtcgcttaacgccaccagctcgctaatatcctgcggcgtaatatcgccatcaagaacagtcatgacgccagcctgacgcgccagcgtaaacgcctgttttgcgccgtcatgccagcgcacatccgccaacaccacatcccactgcgaaaaatcgatgtcgttaagccagtcggcgtcaggtaataaatccgggctgggataattaacgataatccgctctcctttggcatccaccataatcgctgactgcgacgacatggcctgcgtgtagcggcgggtatagcgggtatttacccccagggattccagttccgccagcaggctgtttccggtgtcgtcatcgcccacacggccaataaagtccacctgcgcgcccaatttcgccgcagccacggcagcggtcgccgcaggcccgccgcccacttccgtatagcgcttcgccacatatttgcccccttctgttggtaatccttccacgtaatagatgcgatccatcacggtaatacctacacaagcaatacgaaccatggtcattcctcaagcattttcgatgtgctcattttaatttcacgaaatgtttaaaaagtgacggctgtcaattttttgaccataaattacaaatacgatcacaaacagacagaaaaggctcattaatgacaaaaaatgacaccaccgtgttcaggagaacgatatggcagttatagcatttatcgggttgggacagatgggctcccctatggcgagcaatctgctaaagcagggccatcaactcagcgtcttcgatattaatcccgacgccgtacagcgtctggtagacaaaggcgcgcaacctgcaagcagcccggctcagacaaccatcggcgctgaatttgttatcaccatgctcccgaacggcgatctggttcgttccgttttgtttggcgagcaaggcgtttgtgaaactctttcccgtgaagcgctggtcattgatatgtccactattcatccgttgcaaaccgataagctgattgccgacatgcagagcaaagggttcagcatgatggatgtgccggtaggccggacatccgacaacgcgattaccggcacattgttgttgctggcaggcggtacgacggagcaagtagagcgcgctacccctgttctgatggcgatgggtaatgagctggtcaacaccggcggcccgggaatgggtattcgcgtaaaactgatcaacaactacatgagtattgcgctaaatgcgctctccgccgaagccgccgtgctgtgtgaagcgctggggctttccttcgacgtggctttaaaagtgatgagcggcactgccgcaggcaaagggcatttcaccaccacctggccgaataaagtgatgaaaggggatctgtctcccgccttcatgatcgatctggcgcacaaagatcttggcatcgcgttggatgtcgccaatcaactgcacgtaccgatgccgctcggcgccgcctcccgtgaagtttataacctggcgcgggccgcaggccgcggtcgggaagactggagcgccatcctggaacaggtgcgcatcagcgccgggctgactgccaacgtaaaaaagtaacgactgtataaaggaaaattgaatgaacaactacaccatcaaagacattacgcgagcgtccggcgggtttgccatgctggctgtcgatcagcgcgaggcgatgcgtttaatgtttgctgctgctggtgcgaaaacacccgttgccgatagcgtgctgacggatttcaaagtgaatgcggcgaaaattctttccccgtatgcctctgccgttctgctggatcagcagttctgttatcgccaggccgtagaacaaaacgcggtcgctaaaagctgcgccatgatcgtcgcggcggatgatttcatcccaggcaacggtattcccgttgataacgtggtcattgataaaaaaattaatgcgcaggcggtaaaacgggatggcgcgaaagccttaaaactgttggtgctgtggcgcagcgatgaagacgcgcagcagcgtctggatatggttaaagaattcaatgaattatgtcactccaatggtttgctgagcattatcgaaccggttgtacgtccgccgcgctgcggcgacaagttcgatcgcgagcaggcgattatcgatgcggccaaagagctgggcgacagcggcgccgatctttacaaagttgaaatgccgctctacggcaaaggcgcgcgttccgatcttcttaccgcctcacaacgcctgaatgggcatatcaatatgccgtgggtcatcctctcttccggtgtggacgaaaaactgttccctcgcgcagtcagggtcgccatggaagctggcgcatccgggttcctggcgggacgcgcggtctggtcatcagtgattagtttaccggataccgagctgatgctacgtgatgtttccgcgcctaaattgcaacgtctgggcgagatcgtcgatgaaatgatggcaaaacgtcgttaatacgaggatgaaagaatgaaatggtttaacacgttgagccacaaccgctggctggagcaggaaaccgaccgcatctttaatttcggtaaaaacgccgcggtgccgacaggcttcggctggctgggaaataaagggcaaatcaaagaagagatgggcacccatctttggatcacggcgcgtatgctgcacgtttattccgtggcggcgtcgatgggccgaccgggcgcttatgatctggtcgatcacggcatcaaagccctgaacggcgcgctgcgcgataaaaaatacggcggctggtatgcctgcgttaacgatcagggcgtggtggatgcctctaaacagggttatcaacacttcttcgccttgctgggtgcggccagcgccgtcacgaccggacaccctgaagccagaaaattgctggattacaccatagaaatgattgagaaatacttctggagtgaagaagagcagatgtgccttgagtcctgggacgaagcctttagccagacggaagattaccgtggcggtaacgccaatatgcacgccgtcgaagcgttcctgattgtttatgacgttacccatgacaaaaaatggctggatcgcgctatcagaatcgcatcagtcattattcatgatgtagccagaaataatcattaccgtgttaatgaacatttcgattcacagtggaaccctatccgcgactacaacaaagataatcctgcccaccgtttccgcgcctacggcggtacgccaggtcactggattgagtggggccgtctgatgctccatctccatgctgcgctggaggcccgcttcgaaacgccccccgcctggctgctggaggatgcgaaaggtctgttccatgccactatccgcgacgcctgggcgccagatggcgcagacggttttgtctactcagtcgactgggacggtaaacctatcgtacgtgaacgcgtgcgctggccgattgtggaagcgatgggtacggcctacgccctctacaccctgacgggcgatagccagtatgaagagtggtatcagaaatggtgggactactgcattaagtacctgatggactatgaaaatggttcctggtggcaagagctggacgccgataacaaagtgaccaccaaagtgtgggacggcaagtaagatatttaccatctgctgcactgcctggtcattcctcgtctgccactggcgccgggcctggctccggcggtcgcggcgggtctcctggatatcaacgcgaaataggtcatgaggatggcagccatgcacagcggtggaaaaactattcagcttaatgcgggccattaccaggcgaaaatcgtcacggttggcgcaggtctggcggaactgactcatcatggacgtcatgtggtcatcccgcataaaccggaagaaatacccatggcgcatctggggaaggtattgattccctggccaaatcgcgtgacaaatggctgctactcctataacggcaaagttttccagcttgccgttaacgacccggtttcgcagaccgccattcacggtctgttagcctggcgagactggcagattaattatcagtcggcgacggaagcgtcgctaacgatttttctgccgccctcttacggctatccctttgcgttgatatcggaagtgatttatcggttagatgccgccagtgggctgcacgtattgattcgtacgcaaaacattggcgatgaatcagccccttatggcgcgggcgcacatccttatttgacttgtaatctgcaaagcatcgatagctgtgtattaacactgcctgcaagcgaagaattgcccgcaggcaggaatttttccgcatcatgcctgctcggcgaaacgcgccttgatcatgcggttaagaccgcgactgccccggcggagtgggaggtcagacttaccagcccaacgcagaacatgtctacatttttacgcagcaagcaaccctggctacagatctataccggcgaaaaactcagccgaaaggtctcgcggtagagcctatgagctgcccgcccgatgcatttaattccgggatcgcactgattcatcttgccccaaaagcgatccatcaactgcatttttccatcggctgcgactagcccaaatggattaccgaattaccctacattcacggagattacaatgaattctctaccacaacggtcaaccgattttgaactgacaacatcacaggatggttttgcgcttagctggcaacagcgcctgattttacgccacagcgccgaaaacccctgtctgtggattggcgcgggcgttgccgacattgacatgtttcgcggcaacttcagcatcaaagacaaacttaacgagaagattgcattaacggaggccaccgtcagcgagctacccgacggctggctggtacaattcagccgtggcgcaacaattagcgccacccttcgcatctccgccgatgaggcgggacgcctgacgttggatctgcaaaacgacgacctgcaccataaccgtatctggttacgcctcgcagctaatccagacgaccatatctacggctgcggcgaacagttctcttatttcgatttgcgcggcaagccgttcccgctgtggaccagcgaacagggcgttggccgtaataaaaccagctatgtcacctggcaggcagactgtaaagagaacgccggcggcgactattactggaccttcttcccgcaaccgacctttgtcagcacgcagaagtattactgccacgtcgataatagctgctatatgaatttcgacttcagcgcgccggagtatcacgaactggcgctgtgggaagataaaactacgctgcgttttgagtgtgccgacacctacatcgccctgctggaaaaactgactgcgctgttaggtcgccagccggagctgccggactgggtttacgacggcgtcacgctcggcattcagggcggtacggaagtttgtcagcaaaaactggataccatgcgcaacgcaggcgtaaaagtgaacgatatttgggcgcaggactggtccggtatccgcatgacctcctttggcaagcgcgtgatgtggaactggaagtggaatagcgacaactatccacagctggatagccggatcaaacagtggaaagaagaaggcgtccagttcctctcttatatcaacccatacgtcgccagtgataaagacctctgcgctgaggcggcgagacacggctatctggcgaaagacgccacgggcggcgactatctggtcgagtttggcgaattctatggcggcgtggtcgatctgactaatcctgaagcttacgactggttcaaagatgtcatcaaaaagaacatgatcgcgctcggctgcagcggctggatggcggatttcggcgaatatctgccgaccgacacgtatctgcacaacggcgtcagcgcagagatcatgcataacgcctggcccgcactgtgggcgaagtgtaactacgaagcgctacaggagaccggcaagctcggcgagatcctgttctttatgcgtgcgggttacaccggcagtcagaaatattccaccatgatgtgggcaggcgaccagaacgttgactggagtcttgatgatggtctggcctctgtcgtgcctgctgcattgtcgctggcgatgaccggccatggtctgcatcacagcgatatcggcggctacaccaccctgtttgacatgaagcgcagcaaagagttgctgctgcgctggtgcgatttcagcgcctttacgccgatgatgcgcacccatgaaggcaaccgccccggcaataactggcagttcgacggcgacgcggaaactattgcccactttgcccgcatgaccaccgtctttaccacgctgaaaccgtatctcaagcaggcgatggcgcaaaacgcggctaccggtctgccggtcatgcgtccgctattcctgcactacgagaacgatgccgctacctacaccctgaaatatcaatatctgctcggtcaggatctgctggtcgcgccggttcacgagcaggggcgttgcgattggacgctgtacctgccggaagatcactgggtgaatatctggaccggcgaagctcaccacggcggtgaaattaccgtggatgcgccgattggcaagccgccggtcttctatcgcgcgaagagcgagtgggctttactttttgcttctttacggaatatctaatacggctcgcccgcagggaaacctgcgggcagatggagaagaataatgagtcaaacatcatcgaatccggcaaccatacgcttgccgtttaaagaaaaacttgcctatggactgggggatttaggttccaatatcctgttagatatcgggaccctctatttactcaaattttataccgatgtgctgggtttaccagggacttacggcgggatcattttcctgatcgccaaattttttaccgcatttaccgatatgggtaccggcattatgctcgactcgcggcgtaaaattggtccgaagggcaaattccgcccgttcgtgctttacgcggcatttccggtaacgctactggcgattgctaactttgtcggcacaccgtttgaggtgacgggaaaaaccgtcgtcgcaacgatgctgtttatgctgtatgggctggttttcagcatgatgaactgctcgtatggcgcgatggtgcccgcgattaccaagaacccggatgaacgcgcctcgcttgccgcgtggcgtcagggcggcgccactctcggcctgctgctgtgtaccgttggctttgtgccggtcatgaacctgatcgaaggcaatgcccaactcagctatattttcgccgccacgctattttcattgtttggcctgctatttatgtggctgtgctacgccggcgttaaagagcgctacgttgaagtgaaacctgtcgatagcgcgcaaaagcctggattattgcagtcgttccgcgccatcgccggtaaccgcccgctgtttattctgtgtatcgccaacctttgtactctcggcgccttcaacgtcaaactggcgattcaagtttattacacacagtacgttcttaacgacccgatcctcctctcctggatgggcttctttagcatgggctgtatttttatcggcgtctttttgatgcccggcgcagtcaggcgttttggcaagaagaaagtctatatcggcgggctgttaatatgggtggcgggcgatctgctcaactacttctttggcggcggctcggtcagttttgtcgccttctcctgcctggcgttcttcggttccgccttcgtcaacagcctgaactgggcgctggtttccgacacggtggagtacggtgaatggcgcaccggcgtccgctcggaagggacggtttacaccggcttcacgttcttccgtaaggtctcccaggcgctggcagggttcttccccggctggatgctgacgcaaatcggttatatcccgaatgtggtgcaatcggcaggcaccgtcgaaggcctacgccagttgatctttatatatccttgcgtgctggcggtcatcaccattattgcgatgggctgtttctacaacctcaacgagaagatgtacgtgcgaattgtggaagagattgaggcccggaaacatacggtttaacaacaataaaatataacgccctgcggggcgttttgagaggcgattatgtctaatcatgatccgctaacgctaaagttgagcctgcgggaaaaatgcgcctatggcgtgggcgatttcggctcaaatctgatgctgtgtatcggtacgctgtatctactgaagttttataccgatgaactcgggatgcctgcatattacggtggaattatctttctggtggcgaaattcttcactgcttttaccgatatgctcaccggcgtattgctggattcacgccgtaatattggcgcaaaaggaaagtttcggccttttattctgtatgcgtcatttccggtggctctggttgctactgcgcaattctttgccactcactttactttacccgttaaaacagccttcgcgacggtgctgtttatgttgttcggtctgttctacagcctgatgaactgctcatacggcgcgatggtacccgctattaccaaaaatccgcatgagcgggcccagctcgccgcatggcgacaaggcggcgctaccattggccttcttctttgtaccgtaggttttatgcccattcaggcgctgtttacccgttccccttcgctgggttatctggttgcagcagtcattttttcggtctgcgggctgttcagcatgtggtggtgctttagcggggtgaaagaacggtatatcgaaaccgtacctgacacgcataaacccagcatattgaagtccttctgcgcgatttttcgtaatccgccgctgctggtgctctgcgttgccaatttgtgcacgctggctgcctttaatattaagctggccattcaggtttattacactcagtacgtgctgaacgatattcatttgttgtcatggatgggttttttcagcatgggctgtatcctgattggcgtcttattagtacctgatgcggtaaaacgcttcgggaaaaaacaggtttatcttggtggtctgatactgtgggccgttggcgatatcctgaattttatctggggcggaacgtcattcctgtttgttattttctcttgtattgccttcttcggtaccgctttcgtcaacagcctgaactgggcgctggttccggatacggttgactacggcgaatggaaaacgggtattcgcgctgaaggctcggtgtatacgggttataccttttcccgcaaaatttccgctgcgcttgctggctttttgccaggtattatgctgacgcaaatcggttatatccccaacatagctcaaagtgacaccacgttgcttggtttgcgtcagctcatttttttatggccttgtggtcttgccattatcgcagcactaacgatgggctttttttataagctcaatgaacaacgtttcgcttttattatcgaggaaattgcccaacgaaagaaaacaggcaatcaaattgtcgcaactaataataaacaaagtatttctactgtaaataattaaacgacgcttgccgctttattcatcccgatggatggcggcttccctatatttgaaaaatggatttattatgaaatctctgaatactctagtgatattaacttcagtaatatccacctctgtttttgctggcgcttatgtagaaaaccgtgaggcctataacctggcgtctgaccaaatggagtttatgctgcgcgtcggctataactccgatatgggggccggaattatgttgaccaatacctatacgctacagcgtgatgatgaattaaagcacggttataatgagattgagggctggtatccgttatttaaacctacagataaattaaccatccagccaggcgggttaataaacgacaaaagcattggttccggcggcgccgtctatctggatattaactataaatttaccccgtggtttaatcttacggtacgtaaccgatataatcacaataattatagttcaaccgatttgaatggcgaactggataataatgacagctatgaaatcggtaactattggaattttatcattaccgataaattttcttatacctttgaaccacactatttttataacgttaatgattttaatagtagtaatggtacgaagcatcattgggaaatcactaataccttccgttatcgtatcaatgaacactggttgccctactttgaattacgctggttagatcgtaacgtgggcctctaccatagagagcaaaaccagattcgtatcggggcgaagtatttcttctgatattatcgcctctattttccgaatctgcatcacagcgggtagttgttctgcccgctcattcatcctgaatcagactcccgatatcccgcctctaagcgccatgataatattcgcaaagcgttttaccatattcatgcttatagagaagggaaacaaatgaataagcgattcaatattgattgggacaatgaattaacccaggaacagctcattaatttaattttaaccgatgaagatctgccaaagcttcgctcactgaccattggtaactggggtgattgttgggaagacgaaacctgccagcctattattgatatgattgtggagaacgccccccgtttttctcacctggaatcactgtttatcggtgatatggagagcgaagactgcgagatctcctggattaaacaaggtgactattccaggctctatgcggcgttacccaatctgaaggaactgattattaaaggcgcgtcggatctgcgactgggcgctatacatcatgagaaactggagcacctggaaatcatttccggcggcatcccttctaacgtacttgccgaactacaaaatgcgcagctccctgcattaaaaacgctgaagctcttcctgggcgtagaggaatacggttttgacggttcgctggataacgtgatggcgctggtatcgaaagatcttttccctcagctcaaccatctggggttgatgaacagtgaagagcaggatgatatcgcccgccgggtgctggaaagtaatatcctgccgcagcttaacgtgctggaactctcatgcggtaccttaactgatagcggcgcagaggcgctgctggagcataaagaccgaattgcgcatctggaaacactcgatctccaccaccactatttgacgccggagatgcaggaaaagctaaaagccgcgctgccgataccgctgaatctttcagaagcgctggagcctgatgattacgatggcgatatttatatgaatgcgatgtacaccgagtgattgtgtaggggaatgtgcacattcccctacacaccgataaagggatttattgtgattacgctcattggcccccatcagagcaagcgcacgcattattttatgcaggctgccgccatacttggagaatccgtcacggcgctgactcatccgcaagcgctggacgcttcgctgacctctggcatcgttaaaatcgacccgccagtacacaatgaaactaacatccgcaaaataaacgcgatcggtctggactatatccattttttgcagaacatggcagcgcgtcctggcatcacctagcttaaccatccggcgggcctcattcacctgttggataaaaaacgctgcaagcggcgcttactggaacacggcatccccacgccgccgttggtagcggaagacgtaaaaagttttgcacagctcaccgccatcatggaggaaaaaagggtcgccagcgtgttcattaagccctcgctgggttttggcgcggcgggcgttatcgctttgcgccgtcatcctgacggcgcaaagcaggtgctttacagcgcgattgccatatcagggcaacagctatttaacagcaaaaaaatccaacagtatcgtcagaaagaagatatccagctcattattgatggcgttcttcagcaggaaaacctcgtcgaacagtggctgcccaaagccagcgtaaagcataaaacctatgatttacgcatcgtctgtctggatggcgaaattatctggcgagtggtcagaacctcctcgcagcccattactaacttacacctgcaaaaccaggcttaccgcttcgaaagtctggagttatctgccgcaaaagtggctgagatcgatacgctctgtcaaaatgccatgcggctttttcctggcattcgcttagcgggtattgatgttttacttaccaccagcctgacgccgtatattattgaaattaatggccagggtgatttgatttatcaggatgcgcagcagaacaatctaatttatcaggcgcaaatccgggccatgaggaagcaaaatgtataattcaatggatgaagtccccgtctcgctacacgcgtcgattgacacaggcgatggcgaattcgatatgaatgcgctaattagtaataacgctcatattctttttattgtactggactcgttacgctacgatattgcgcttcaggaacaaaccgccggaaatacgcccaaccttaatcattatggacaatggacgaaatgcgaggcggccggtaattttacctggccttcgcatcacgccatgttttcaggttttatgccaaaacctattgatgataccgttaatcagaccatgctgcttttcccaaaagatatcggacttggtcgtaaaggcccgaaaaatgcatttgcctttgatgacgcaacatggataaaaagtctggaaaataaaggctaccagaccatctgtattggcggcgtctctttctttaataaccgctccggcatgggaaaagtgttcccgtcgatgtttaaagagagttactggcatccacgctttgcctgtacggttaaagaaagtatggataaccagatccattatatccagaaaatcatggccgaacgtgctggcagccaaccggtcatgatgtatatcaatatcgatacgattcattaccctaaccatttttacgttgagggcgcggcccctggcgataccgtagagacccatgccgccgcgctacgctatatcgacgcccgcatcgacggattactgaacattttccgccaaaccggcggcgaaacgttcgttattgtctgttccgatcacggtacctgctatggcgaagacgggaaatatttccatagttttaatcatccgatcgttaataccgttccttatatgcatttcttattgagcggtaatcattaatatgaataacaatgatatttatcgtcagtatatgtacagttatccgcataagacggcttatcgggagctggagaacgtcagctttagcaaagtaaaaccgcgcatttacgagcacgacacacatctgtatgttcatatgccgttttgtcaaagtcgctgcgggttctgtaatttatttacctgcactggcgcagataatacgttcattgatagctatatcgacgcgattattacctagggccgacaaatggcgctggcgcccgtccactgggcaagcttcaccgtaggcggcggcacacctctgctattaaacattgcgcaattagaaaagttatttttttccgtctttgatgtgctcaatgttgactggaatatttataaaacaattgaaacttcccctacggataccacggcagaaaaagtagcgctattaaacgccttttccgttaatcgcgtcagtattggcgtacaaagttttcatgatagcgagttacatacgctgcatcgccgccacaataccgccagcgcgcaccaggcgttggaatggctaaaggcaggtcattttccatcactcaatattgatattatttacggcattcccggccagactcacgcaagcctgacggaatcgttacatcaggcgctcgtttatcaaccggaagagctgtttctttatccgctttataatatgcctcgccaggaaaatatgcatagctactacgttttagcccgcgatcttttacgcaacgcgggctacacccaaacgtccatgcgccgtttcgtccttaatccagcgccatccgccgcggcggaaagctgcggatttgaaaactcactggcgctcggcgcggacggcagaagttatcttggcaatctgcattactgttcaccgtggccgtcgaacctgcaaacatcacgaaaaatcattcaggcgtttatcgacagcccggacaaaaccgtcattaatcacggttatctgctcccccctgatgaaatgaaacgccgctttatcattaaaaatctatttttctggcaaggactttctcttagcgattatcagcaatattttaccagcgatgcgctaagggatttccccgacctggaacgctttatacggcagggctactgttatcagaatggcagtcgcctccggctaacggagaccggtatggcattatccgattgccttgctcctgtgttcgtttcgcctgaggtgatgctacgggagaatcggcagagatgagcatccccgccctgcgcgatattcatacgctgttttatcgcggctatcttaagtcgtgtaattatcattgcggctattgcccgttccataaacacgcccgcaacgataaaaaacgcgacgaagccgcgctatggcgcatggttgaccatttgcctcttttaggtacgccgttgaatgtgatgattacgccttatggcgaggcgctacgcttgcgttattacatggcggcgctggcagacattagccgctatcctcatgttcaggcggtcggcatacaaactaacgcctctttttcgttaatgtcattgctggagtcatttcgtgctggcggcggagatatctcaaagcttcggttatggtgttcttttcatccctcacaaattaccgctgaacgctttctccagcagtgtttagcgctctctgccgccggaataacctggtgcgcgggggctgtcgccagtatgaaagatatcgaccagtttcgttggctacgccagcggttgcctgaccagaattatttttggtttaacgccaacgagtgtgccaatacccggcataccgttgaggaaaccatcgccttcagcgaactcgatccgctgtatgtggttgaaacgcagcagtggccagcgcagctggatatctgtaccgcaggaagaaaaagtatttttatgaacgcagaaggcgatctttttgcttgtcatatcagcaaaattaaaatgggtaatttatatcagcaacggctcaattctcctgcctgccaggcaaaacaatgccactgttttctcgcttatcagcaccgtctcgatattccattgctgaatcacctggatgcctcacgctgttttaggatcgggcgctcatgcgatatcgtttaatcgcttttgatcttgatggaacgctgctaaaccgtaataaacaaattctgccagagtcgctaaccgctatccgtcagatgcaggacatgggctgccgaataatgcttgtcaccggtcgctctcatcgtgaagcctatgcgtattatcaaacgctggcgctcaccgaaccgatgatctgttgtaacggaagttatatttatcaaccggctcaacagcagatccttgatccgctgccgctgacgcacttacaaacggaaaaaatactggcgcgggtatatccgcttaaaccgacaattcgtgctgatgataaaataatctttcaggctgatgagctaagcagtagggagaatatttggcaaatcagcgtcgttcatcggcacataaaacaactacaaaatattgctgagtttatacagcatgaattacagctaagctgtacctggtcctggcatcatcaactggatattctccagaaggggtgtagcaaaggacaaagcctcgccagatatgcacagcaacagcatatcgcaatgcgcgaagtgatggcgtttggcgataatgataacgatgcggaaatgctacgtttagccggattgggtgtcgcgatggggaatgccagcgctcgggcaaaggtgtatgcggatagcgtcattggtcggcataatacgccaacgattgctgattttttgacaaccttatccctttctcaacgtgaataaaaaaaccccgccgagttttcatttcggcagggtttttatccgtaagaacgttaattactcttctttctgaccacggttcgcacggcggcgatcgttttccgtcaggtgacgtttacggatacggatagaggttggagtgacttctaccagttcgtcgtcatcaatgaactccagcgcttgctcaagactcattttaattggcggaaccagaatcaccgcttcatccgtaccggacgcacgcatgttggtcagtttcttaccggtcaggcagtttaccgtcaggtcgttggagcgactgtgaataccaataatctggccttcgtaaacttccgcgccgtgacccaggaacagcttaccgcgatcctgcaaaccgaacagcgcaaacgccaccgctttaccctgaccgttggagatcagtacgccgttctgacgctggcccacttcacccggacgaatatcgtcgtaatggctgaaggtggagtacagcagacccgtaccggaagtcatggtcatgaattctgaacggaaaccaatcagcccgcggcttgggatcacgtagtcgagacgtacgcggcctttaccgtccggattcatgtttttcagatcgcctttacgctcgcccagcgcctgcatgacagacccctggtgctgctcttcgacgtccagcgtcacgttttcgtacggctcttgtttacgaccgtcgatttcacggaagataactttcggacgggaaaccgccagttcgaaaccttcacgacgcatgttttcaatcagcacggacaggtgcagttcgccacgaccggatacacggaacgcatccgcatcttcggtttcttcaacgcgcagcgccacgttatgcaccagctctttgttcagacggtcaagaatctgacgagaagtcacaaacttaccttctttaccgcagaacgacgaggtgttaacgcagaagaacatagacacggtcggctcatcaacggacagcgccggcagcgcttcaacgttctgcgggtcgcagatggtgtcggaaatgttcagctcgcccagaccggtgatcgcaatgatatcgcccgcttcggcgatatcgctgtcgatacgctccagacccagatgcgtcagcaccttacctactttcgcgttacgggttttcccttcactatcgatgatagtgacctgctggttcggcttcactttgccgcgtttgatacggccaatgccgataacgccaacgtagttgttgtagtccagctgggagatctgcatctgcaacggaccatcgaggtcaacgtccggcgccggaacatgatcaacgatcgcctgatacagcggggtcatgtcttccgccatatcttcgtggtccagacccgcgataccgttcagcgccgaagcgtagatgatcgggaagtccagctgttcgtcggtcgcgtcgaggttaacaaacaggtcgaatacctggtcgacaacccagtcagggcgcgcgccaggacggtcaaccttgttgataaccacaatgggtttcaggccatgagcaaaggcttttttggtcacgaagcgcgtttgcggcatcgggccgtcaaatgcgtcaaccaccagcagcacagagtcaaccatggacatgacgcgctctacttcaccaccgaagtcagcgtgcccgggagtatcaacgatgttgatacgataatcattccatttaatagcggtgtttttagcgaggatagtaataccacgctctttctccaaatcgttggagtccatcactcgctcttgagtttcggcacgcgcgtcgaacgtaccggattgctggagcagcttatcaaccagggtagttttaccatggtcaacgtgcgcgatgatggcgatgttacgcaaattttcgatcacaactttgcctcaggcattagaaatagcgcgttattgtacacggattaatcgcactacaaaacaggatcacaaacatcctccgcaaacaagtattgcagagtctctttgtgatcgctttcacggagcgttaaaagggtggcttgcgttctattgcaccaatgtggtgcttaatgttcacattgaagcactattttggtgcaacatagtcaccgtggtgcagcccttttgcacgatggtgcgcatgataacgccttttgggggcaatgtgaaagttggcacagatttcgctttatatttttacggcgacacggccagcagaattgaagatctcgttaccacgacgaccgaccatgaccaatccgggagagtacaagtatgtccgctgaacacgttttgacgatgctgaacgaacacgaagtgaagtttgtcgatctgcgcttcaccgataccaaaggcaaagaacagcacgtcacgattcctgctcatcaggtaaatgccgaattctttgaagaaggcaaaatgtttgacggctcctctatcggcggctggaaaggcattaacgaatccgacatggtgctgatgcccgatgcgtccactgcggttatcgacccgttcttcgcggactctaccctgattatccgttgcgacatcctggagcctggcactctgcaaggttatgaccgtgacccacgttccatcgcaaaacgtgcggaagactacctgcgcgcgaccggtatcgccgataccgtcctgtttgggccggaacctgaattcttcctgttcgacgacatccgcttcggcgcatctatctccggctcacatgtggcgattgacgatattgaaggcgcctggaactcctctaccaaatacgaaggcggcaacaaaggccatcgcccgggcgtgaaaggcggttatttcccggttccgccagttgactccgcgcaggatatccgttctgaaatgtgtctggtcatggagcagatgggcctggttgttgaagcgcaccaccacgaagtagcgaccgcaggtcagaacgaagtggcgacccgctttaacaccatgaccaaaaaagccgacgaaattcagatttacaaatatgtcgtgcataacgtggctcaccgcttcggtaagaccgcgacctttatgccaaaaccgatgttcggcgataacggttccggtatgcactgccacatgtcgctggcgaagaacggcaccaacctgttctctggcgacaaatatgccggtctgtctgagcaggcgctgtactacatcggcggcgtcatcaaacacgccaaagccatcaacgccctggcgaacccgaccaccaactcctacaagcgtctggtcccgggttacgaagcgccggtgatgctggcctactccgcccgtaaccgttccgcctccatccgtattccggtggtggcgtctccgaaagcgcgccgtatcgaagttcgcttcccggacccggcggctaacccgtatctgtgctttgccgccctgctgatggccggtctggacgggattaagaataagattcacccgggcgaagccatggacaaaaacctgtatgacctgccgccggaagaagcgaaagagatcccacaggtagcaggttctctggaagaagcgctgaacgcgctggacctggaccgcgagttcctgaaagcaggcggcgtgttcacggatgaagcgatcgatgcgtatattgcgctgcgtcgcgaagaagatgaccgcgtgcgtatgaccccgcacccggtagagtttgagctgtactacagcgtttaatcgtatattaaaaatccgacgaatttcgcgttgctgcaaggcggcaactgagcacatccccgggagcatagatagcgatgtgaccggggtaagcgaaggcagccaacgcagcagcagcgtgaaaggcgtcaggagtttttgagttgccgtggaaactttcagcccatcccaggatgggcttttttctccaccaacaatctgatctcacgcgctttttagtggtaaaaagctataatgcactaaaatggtgcaaccttttccaggagactgctgaatggcaagcggcatacagcccgatgctgggcagatcctcaattcgttaatcaacagcgtgctggtggtcgacgacgcgctggcaatccattacgccaaccctgccgcgcagcagttgctcgcgcaaagctcacgcaaactgttcgggacgccgttacctgaactgttgagctatttttcgttaaacattgacctgatgcgcgaaagtttagcggcaggacaaggctttaccgataacgaagtgacgctggtgattgatagtcgctcgcatattctctctttgaccgcccaacgtctgcccgacgattttatactgctcgaaatggcgccgatggataaccagcgtcgtctgagtcaggagcagttgcagcacgcgcagcaaatcgccgcccgcgatctggtgcgcggtctggcgcacgaaatcaaaaatccgctcggcggcctgcgcggcgcggcgcagctactcagcaaggcgctgcccgacccggcgctaacggaatataccaaagtcatcattgaacaggccgacaggctacgcaaccttgtcgatcgtttgctggggccgcagcacccgggaatgcacattaccgagagcatacataaagtcgcggagcgcgtggtggcgctggtgtcgatggaactgccggataatgtccggcttatccgcgattacgaccccagtctgccagaactgccgcacgacccggaacaaattgagcaagtactgctgaatattgtccgcaatgccttgcaggcgctggggccggaaggcggcgaaattacgctgcgtacccgtaccgccttccagttaacgctgcatggcgaacgctatcgcctggcggcgcgtatagacgttgaagacaatgggccgggcattcctccccatttacaggatacgctgttctacccgatggtcagcggtcgcgaaggcggcaccgggcttgggttatctatcgcccgcaatcttatcgatcaacacgccggcaaaattgaatttaccagttggccggggcataccgagttttcggtttacctgccgattcggaaatagaggtgtttatgcaacgaggaatagtctgggtcgtcgatgatgatagttccatccgttgggtgcttgaacgtgctctcgccggggcagggttgacctgtatcacctttgagaatggtaatgaagtactggctgcgctggccagtaaaacgccggacgtcttgctgtcggatatccgaatgccaggaatggacgggctggcgctattaaagcagattaaacaacgtcatccgatgcttccggtcatcattatgaccgcgcattccgatttagatgccgccgtgagcgcttatcagcagggggcgtttgattatctgcctaaaccgtttgatattgatgaagccgtcgctctggtcgagcgagcgattagccactatcaggagcagcagcagccgcgtaatatcgaggttaacggcccgacaacagacatgataggcgaagcgcccgccatgcaggatgtgtttcgcattattggtcggctgtcgcgttcttcgattagcgtgctgattaacggcgaatcaggaaccggtaaagaactggtcgcccatgcgctacatcgccatagcccacgcgccaaagcgccgtttatcgcgctcaatatggcggccatcccgaaagatttgattgaatccgaattgtttggccatgagaaaggcgcttttaccggggcgaataccatccggcagggccgtttcgagcaggctgacggcggtacgctgtttctggacgaaattggcgatatgccgctggatgtccagactcgtctgttacgcgtgctggctgacggacagttctaccgtgtgggcgggtacgcgccggtaaaagtggatgtgcgcattattgccgccacccaccagaacctcgaacgacgcgttcaggaagggaaattccgtgaagacctgttccaccgcctgaacgtgattcgtatccatctcccgccgttgcgcgagcgccgtgaggatattccgcgcctggcgcgccattttttgcaggtcgccgcccgtgaattaggcgtggaagccaaattattacatccggaaaccgaaacggcgttaacgcgcctggcatggcctggtaacgtgcgtcagttagaaaatacctgccgctggctcaccgtcatggccgccggacaggaggtattgacccaggatttaccgggcgaactgtttgaagcctcggcgccggatagcccgtcccacctgccgccggatagctgggctacattactggcgcaatgggcggatcgcgccttgcgatccggtcatcaaaacctgctttctgaagcgcagccagaactggaaagaacgctactgaccacggcgttacgccatacgcagggtcataaacaggaagccgccaagctgctcggttggggtcgaaacaccctaacgcggaagttgaaagagctgggaatggagtaaacattatccgcgagtgtaaagattaataattgagcgcaaaacgctgctattttgcgctttactgttccgatgagttcagtatgatcatgcccggcaaacggggggattcattatgttagaatctattattaatctggtatcgagtggagcggtcgacagccacacgccacaaactgcgctagccgccgtgttgtgtgccgcgctggtgggactgttcagctgacaatgtgccggatggcgctaatgcttatccggcctacaggttgtcgcaacgtgtaggcccggtaagcgcagcgccaccgggcaacccggctaaatgacgcgcgagaactgctgcatccgcgctttctggcgcagatacgcgtcaaagcacatgcagatattgcggatcagcaaacgacctttcgccgtcacctgaattcccttctcgctaatatccaccagcccatctttcgccagcggcgacagtaactgcaaatcttcggcaaaatattcagcgaaatgcaaaccccactgctgttcgacagcgttaaaatccaggcggaagttacaaatcagcgccttgataacatcgcgacgaatgcaatcatcacgggtcagcgtaataccacgccatagcgcattgccccgctcatccacttgctggtaataacgcttcagctctttctggttctgcatgtagccatcgccaatcatgctgatagcagaaacgcccatccccagcagatcggtatcgccctgggtcgtatagccctgaaaattacggtgcagcacgccttcgcgctgcgcgacggccagttcgtcatccggacgggcaaaatggtccatcccgataaactgataaccggcctgagtaagcgatacgatcgtctcctgcaaaatatccagtttctgctgcgcgctgggtaaatcggcatctttaattttacgctgggcggcaaaaagcgttggcagatgcgcatagttaaagacgctcaaacgatcggggttcagttccgtcacacgcttcagcgtgaaagcgaagctttccggcgtctgtttcggtagaccgtagatcaagtcgatattggtcgaggtaaagccgatatcgcgggcgtgattaagcaacgcaaagatgaattcttcatcctgctcgcggttaaccaggcgctgcacctctttattaaagtcctgcacgcccatactcaggcggttaaaaccttccgcacgtaaatgatcgagcacatccagctcaatttcacggggatcgacttcgatcgagatttccgcgtcggtattaaagtggaaattttcacgcaacagcgtcattaagcggctgatttgcgctttattcaggtaagtaggcgtaccgccgccccagtgaagctggctgacatgacggtctgcaaacagcggcgcgcgatggcgaatttcctgctcaagcgcgtcaagatactggtcagctttatgctgttggcgggtgacaatcttgttgcagccgcagaaataacacaacttgtgacaaaacgggatatgcacatacagcgagagcggacgttcaggataacgcgccacagcctgcaagaatgcggcgtcctcgaagtcttcagaaaactccagcgcggttgggtacgaggtatatcgtggcccggaatagttatatttctggatcagggccagatcccagtctatttgctgttcagacatgctcactccttccgatggcgtctctggcgggtacggcgtaccggcttcacgccatgacgggcggcaagccggctgcgcagccatttctgtcgccgcgacaatcgctgtagtttaacgaataaccacaccagataacatataaccggaagggttataagcaggacgggcaagcccacggtgtaaacccgttagttgccgcctcttagcaggcgcatcatatcttcctgcttctcgtcctcttcgtcgtcttcttcgtcgtcatcgtaagacagaccaagcttctgcatcagttcatcaatacgatccagtttggcatctacccaggcttgatcttccgcactcagggtttcgcccgcttccagacgttctaacagcgcatccaggcgctcatccgtttccagtaaatccaactccgcctgcggtgaaagcataggtttctcacttttcggtttatgctgttgggtcactttttcagtcacgcccaatggaacaggtgttttactgccaatacgtggatctttttgttgattctgattgccgccgcccgaagcggaattgccgcccgccgcgcgacttcccggcgcatggccgcgatgttttttcaggcgtttacggtcgcgcgcctcctggtttaactcttcacgcgttttacgacgctgtttgccaaaggctttactgcgcggtgcagaggttggttttttcatgatgtcagatctttaagccgttttattcagtatagaattgaggcggaatctagcagaaagcaagcaaagaaaaaaggcgacagagtaatctgccgccttttttcttgactcacgacccttaacgggttccaccatccctgttggctatcaacacgccctgtttttcccttagcctggaacattccatgttgtttccatttccttttactaacgtctccggacgtttgtcttcctgacaatcctgtgtcttcgcctcctggcgctcctgaccctcatcctgagtcgttgatcctgttagcgtcctcgctatgtgcattactttactcttttggggtaaactcacaagataccgacacggcaaatccctttttttcagacaattacctttctataaattcatgatttaactatattaactggcttttagcctgacaacaactctgtcatgtcgcataagtgcaatggacaatgtctcacaaagcgtatggcttttgcttacagcaccgacgcgccgaaaaatccgtcttttgctggcgttcaggtataatcgccacaatgctttgactgacggagacgaccgctttgactaacctgaattatcaacagacgcattttgtgatgagtgcgcctgatattcgccatttaccttccgattgcggaattgaagtggcttttgctggccgttccaatgcaggcaaatccagcgccctgaacacgttgaccaaccaaaaaagcctggcgcgcacctctaaaacgccgggccgtacccaattgattaacctgtttgaagtcgtagatggcaaacggttggtcgacctgccgggctatggctacgcggaagtcccggaagagatgaaacgcaagtggcaacgcgcgctgggggaatatctggagaaacgtcaaagcctacagggcttagtcgttttaatggatatccgccatccgttgaaagacctcgaccaacagatgatccagtgggctgtagagagcaatatccaggttctggttctgctgaccaaagcggacaaactggccagcggcgcgcgcaaggcgcagttgaatatggtacgtgaagccgtgctggcttttaatggcgatgtgcaggtagaagcgttttcctcgctgaaaaagcagggagtggataagttacgtcagaaactggatagctggtttagtgaactggcaccggtcgaagagattcaggacggggaataatcacccgctatgccggatggcgccgctgcgcgtcttatccggcctacggtgcgagcgaaacttttcttacgcccaataaaaaacgccccagtcataaactgactggggcggctaaaatattcagccaaatccgattacgtgaagtaaaaggtctgaaagatagaacatcttacctctgtaccctacgtgaataactttactcttttttgagcaacacagaaagaccttttcgtaatttttttttcattctttacatagggaattctaatacccatcacaaaacccccgtgcttatgttgcttaattacgaaaaaagcgcgttattccttaaatgcttagtgcgcttgatcccaattttctccgctaccgacttccaccagcaacggcacatcaatacgcgtgcagttttccatcaactgatggatacgttttgctaccgcatctaagtcgtctttatgcacctcgaacactaattcatcgtgtacctgcataatcatccgcacgcgtggctgctcggcctgtagccaggcatcgacggcaatcatggcgcgcttgatgatatcggcagccgttccttgcatgggagcattgatcgccgcgcgttccgcccccgcgcgccgcgccgcgttgctggatttaatatccggcaggtaaaggcggcgcccctccagagtttccacatagccttgttcttttgcctgagcgcgggtgcgctccatatattccagcacgccagggtagcgttcgaagtagagatccatatacttctgcgcctctttacgcggaatattaagctggcgagaaagaccgaaggcgctcatcccgtaaatcaggccaaagttaatggctttcgcacttcggcgctgttccccggtcacgctatccagcggcaagccaaagacttccgccgccgttgcgcggtgaatatctttcccttcggcgaacgccgtgagcagccctttatcacgggaaagatgcgccataatacgcagctcaatctgtgaatagtccgcagatacgatgagataatcctcaggcgcaataaatgcctgacgaatgcggcggccttcttcattgcgcaccggaatattttgcaggttcggatcggtggacgataaacgtcccgtcgccgttaccgcctgatgataggacgtatggacgcgcccggttttcgggttaatcatcagcggcagcttatcggtataggtggattttagcttcgccagaccacgatactccagaatcactttcggcagcggatagtccagcgccagctcttccagcacctcttccgacgttgacggcgcgccgccaggcgttttcttcaacggcttaataccctgcttttcaaacaggatggtctgcaactgcttcgtcgaggacaggttgaacgcctcgcccgcaatgtcatgcgctttcttttccagttccgccagacgtagcgtgatttcttccgaatgtttgtgcaggacggcaggatcgatttttacgccattgcgctcaacgcgtgacagtaccggcaccagcggcatttcgatgttttcgaaaacattcagcgggcctttgtgctgctggagctcaggccacattttgagatgcaactgtaacgtgacatccgcatcttctgccgcatagcgccccgcttcctccagtgcgatctggttaaaggtgagctggtttttacctttaccggcaatgtcttcaaaggtgatagttttgtgcttcagccaacgatcggacaagctgtccatatcatggcgtccggcgacgctgttcagaatgtaagactcaagcatggtatcgaaggcgataccgcgcagctcaataccgtaattttgcaagacgccgcgatcgtacttgaggttttgccccactttgcgcactttttcatcttccagcagaggcttcagcagttccagagcacgctggcgggagatttgatccggagcgtccagataatcatgcgcgacaggtacatacgcggcaacgccaggttcgatggcaaacgagaggcccaccaggttggcggcgatattatccaggctgtcggtctccgtgtcgaaagcaaaaactggcgcttttttcagcttttcaatccagctttccagcgtaacgtcatccagaatcgtgacataattttcataagagagcgccgctgccggttcgctgggcgattcatcaataacgaccgtttcctgcggtttggccgccggtttcgcgccctttgcctgtagccacttgcctgcctcgacgtccgccgtccagcgcttgaactcatattttttaaacaggcccagcagttcatccgcaatcggctgctgcacttcaagctgttcgcaggtcagctccagctcaacatccgttttaatggtggcgagcttataagacaggtacgctacgtctttattctgcgctaatttaccggccatcgttttggcgccgcggaaagtgagaccggcaattttttccggctcggcgtacagcgtatccaggccgcccaatccctgaagcaaggcttgcgccgtcttctcacccacgcctggtacgcccggaatattatccgaggagtcccccatcagcgccagaaagtcaataatcagctcagacggcacaccgtacttattaacgacttcatccgggccgaggatggtgttagtcatggtgttgatcagcgtaatattctgcgtcaccaactgtgccatatctttatcgccggtgctgattaataccggacgccccaccttctccgcttctcgcgccagtgtaccgataacgtcatccgcttctacgccagagaccgccagcagaggtaaccccatggctttaactatggcatgtaacggctctatttgcgcacgcagatcatccggcatcggaggacgatgcgatttgtagtgttcaaagagctcgtcacggaaggtttttcctttggcgtcaaacaccaccgcagcatgcgtcgactgatactgcatgatcaggctgcgcaacatgttgaggacaccatacattgcgcccgtaggttctcccgcgctgttggttaacggcggaaacgcatgataggcgcgatagagataggatgagccatctacgagaataagtgggttttctgggatctgaaccataatgtccgtgcctgtttaacagattatggttaaaggatgccacatacaggaggaaaacttgagtttttcgccgcatttgcggaaaagttttgtcgatcttcaggatcgctcgcaaaacaacctgtggataactttgtgtgtaaattcttaccattactttaaaatcagcgcgatagccttctcctcttaataattacccattattttcaatgagttgttaacatcacgattttctgattatctgattcatgccgttatcataatgtggatagttgttacgagtgtttctatttcactcagcgccatcattagcatcgttttctgatagaatcagcctcttgcgcccttttcgcacaccgtttatggctaacttttgaataatttattatgacgagaatactcgcggctatcacgctcccattgagtatcgtattaaccatcctggtcactattgtttgctcagtaccgatcatcgttgccggcatggtaaagctccttttgcctgttcccggtatctggcgcaaggtctccattttctgcaatttcatgatgtattgctggtgtgctggtcttgcagcgctgttacgccttaatccgcacttgcaatgggatgtagaagggttagaagggctgagcaagaaaaattggtatttactgatttgtaatcaccgcagctgggccgatatcgttgtgctttgcgttctgttccgcaagcatatcccaatgaataagtactttcttaaacagcaattggcctgggtgccgttcatcggcctggcgtgctgggcattagatatgccgtttatgaagcgctactctcgtagctatctgctccgccaccccgatcgacgtggcaaagatgttgaaacaactcgccgctcttgcgagaagtttcgtcggtatcccaccactatcgttaactttgttgaaggctcgcgatttacgcatgagaaacgtcagcaaacgcattcaccctatcaacatctgttgccaccaaaagcagccggtattgcaatggcgattaatgttttaggctcacagttcgataagctgcttaatattacgttgtgttacccaaacaacgatcgccaccccttctacgatatgctaagcggtaggctgacgcgtattgttgttcgggtgcaactggaacccataaatgaagaactgcacggcgattacgtgaacgacaaaacattcaaacgccgttttcaacgttggcttaatacgctgtgggataagaaagatatacagatagaagagattaaaacatcttataaaaacgccggtcagtgaccggcgttctttttattttttatcaaccaaatatttcacggtatcagcatactgctgaacaaaaacatccatgctgctggtatccatgccttgtgggttaatctggtatttgccattgacgaacatcgccggaacgccctgcagttgcaggtcagccgcggctttctcctgttgcgcaaccagtgatttcaccacgaagctgttccatgccgcatcgtaatcttcgccttttacgcccgcatcaacgaacactttacggatatccgcggcagattgtactgtctgggttttctgtacggcttcaaacagcgggaccgtgactttatcttctacccccaacgccatcgccaccgcccatgcctgggtgagctccttgcccaacggccccaggaactcaacgtggtacttggtcatcttggtgcctttcggcagctttttcttcacattgtcagacacatgaagcacttcttcaaactgataacaatgtgggcagtagaatgagaaaaactccagtacctggggttcgccagcgaccggtttatccagcgtgatatactgtttaccgtcgctgatctgtgctgccgaggcgctaaaaactaaaaccataccagccagcgccagccaaatctttttcatgatcaactctctccgattaatacattggcgttaattgtaaagggggttcgtgcaaaattttagtctgctcaataaaagtcgttgtctgtcgctgccagtaatcttcccctgttaaccagggaaagttttttggaaacgcaggatcgccccaacgacgaatcaaccaggcaagataataaactaaacgcatggcgcgtaaaggttcaatgagaccaatttcagccgtatcgaactcactaacttcttcataagcttcaataatggtttcaagctgcattcgctgttcggctttgttgccgttcagcagcatccataaatcctgtatcgccgggccgttacgggcatcatctaaatcgacaaacagcggtccatcacgccatagaatgttgccggcatgacaatcgccgtgcaatcgcagcgtggcgaaatcggtgcgccagcattcggtaaccgcagacagtagagtatcagtggctttcaggaaagccgctttttgcccggagggaatcagtgcggcatcttcgaatacctggcgaggttcaaaaagatactctgcaagcccaatgtcaggccggaaagtgaaaggacgttttcgccccgtctgatgcaatcggccaagataacgccctaccgcctccatctgatcgatattgtctgcttcaaactgacgaccgcctacgctggggaaaatggcataatgatagccctgatgcgctaacagcgtctggccattaaacgcgagcggagcagcaaccggaacctcatccttcaccagttcaagcgcgaattggtgttcttcccgaatttgatcaacagaccagcgttcaggacgataaaacttaacgacaaaacgtcgacggtcttcatcctgaaactgatagacgcggttttcataactgtttagtggagtcagcccggaatccaccctgatcccctgttcaaacagcgcatccatgatggtttccgggtgtagcgtctggaaagtaaaagcgttgtcgttcatcccatcatccggaaaatactacgaatgattcaggatatcatttcgtggcgatttcggtggtgccgcttacaaggttttactctttaataacgccgcgggcgcgtaaaagcgccgttttaaagtcctcttcatagtctttttgaatccctggaatggcggcgtctttggcggaatcgcgcattttcagatggtagatcaggatatcatcagttaaatcttccagtttgccgtcaaaacctgactctttcgccagtttctgcaaaaattgcgtcagattaagatcaggctctttctgccaggctggctggaggagttcaatgacttcattcaggcgtttacatttcatagctgtgctccttattcttgatacagacacggtagcagggtcaatcccacaataaaagaggcgatatcggtgaatctggatgaagtaataaccggcgtggtactggcaggcggtaaagcccggcggatgggaggtgcggataaaggtctgcttgaactggacgggaaaccgctctggcgacacgttgccgacgcgctcgcgccacaacttgctacggtcgtaattagtgctaatcgccatctggatatctaccaggccagcggcctgaaagtcattccggattcaatcgctgactttcccggtccgctggcgggtatgctttccgtttttcagcaggtagcaggcgactggtttctgttttgtccctgtgacaatccttgtatcccccacaacctggtcgatcgtttagcagcgcatcgtcatggcgcacccgtggtttgggttcatgatggagaacgcgatcatccaacgatcgcgttgattaatcgtgccgttgagccccagttgacagcttatttgcaagcaggcgagcggcgggtaatgatttttatgcgccaggtaggcggacacgccgttgatttcagcgattgtaaggaggcatttgtgaacgtcaacacgccggaggaactcgcgcaatggcaaaagagaccatgataccgctactcgccattgccgcatggagcggcacgggaaaaacaacactgctgaaaaaactgatcccagcactttgtgcgcacggtattcggccagggctgattaagcatacccatcatgatatggatgtcgataaaccgggtaaagatagctacgagctgcgtaaagccggggcggcacagacgctggttgccagtcagcagcgctgggcgttaatgacggaaacgccggggcaagaagagttggatctggcatggctggtgagccggatggatgcatcaaaactggatctggtgcttgttgaagggtttaaacacgaagcagttgcgaagatcttactttttcgtcagggatgtgggcacagcgaggaagaattaattcttgatgagcatgttattgcggttgccagtgatattccacttgccgtagcggtacccgttttggatcttaatgatgtatcgcagatttctgccttcattttgcggtggttagagaaagcacgttccttgtaggccggataaggcggagccgccatccggcggtgcaggttgcctgatggcgctgcgcttatcaggcctacatttttacagttaccacacatgcaaaaaagcccgtccgtcaggatgggcttcttcactaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaatatctcaaacgtgactcgtaagtcagttttgagatactgatggcaacgcctttcacacattaccgcgcaagtggcgtcccctaggggattcgaacccctgttaccgccgtgaaagggcggtgtcctgggcctctagacgaaggggacgtatcagtctgcttcgcaagacgccttgctattcacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgcccccccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtgtattacgctttcccgcttcagagtcaagcgtttattttcgcttttctccgtgggattctggtctgaaccccgctgacccggcggcctgtgtgccgttgttccgtgtcagtggtggcgcattatagggagttatttctgcctgacaagaggaaatttaaaataattttctgagtgtctcttttttcatcaacagcgggcttaacgtgccataaaataagcaaattgccgttattgcaactgcaatcacacttccaggtggcatactaataaccaaacgaaagagaaaggaagaacattcatgcctttaagcgcacaacaattagccgcacagaaaaatctatcctatgttctggctgaaaagctggcgcagcggatattaaagggtgactacgcccccggtacgattcttcccggcgaaatagaactgggcgagcagtacggcgtaagtcgaacggcagttcgcgaagcggtgaaaacgttgacggctaaaggtatggtgctaccccgtccgcgcattggtacgcgggtgatgccgcagggaaactggaactttctggatcaagagctgctgacctggtggatgacggaagaaaattttcatcaggtggtagatcattttctggtgatgcgtattagcctggagccgcaagcttgcctgctggcggcgactcttggcacaccggagcagaaagcgcggcttaatgccttaatggaagagatggtcgcgctgaaaaagcattttaagcgtgaacgctggattgaagtggatatggcgtggcacgagcatatctacgaaatgagcgccaatccctttctaatctcttttgctacgctatttcattcggtttatcacacttactttacctcaatcacctataacgaggtggtaaagctggatttgcaccaggccattgttgatgccatcgctgatggcgacggcgaacgcgctttccaggcctgtcaggcgttgttaatagcgcccaatgagagaccagataattaacaggatattgaatgaccagcaaaaaagcgcgcagtatggctggcctgccgtggatcgcggcgatggccttctttatgcaggcgctagacgccaccattttgaataccgctttaccggctattgcgcatagtcttaactgttcaccactcgccatgcagtccgctattatcagttataccctgacagtagccatgttaattccggtaagcggctggctggctgaccgcttcggtacgcgtcgcgtctttatggttgccgtaagtctgtttacgttaggctcgctggcctgcgcgctctccagttcactatctgaattggttatttttcgcgtcgtacaaggcgtcggcggagcgatgatgatgccagtggcgcgactggcgttattgcgagcctatccgcgtagtgagctgctgcccgttcttaactttgtcactatgccggggctggtaggtccgattctggggccggtattaggcggcgtactggtgacctaggcaagctggcactggatcttcctgattaatattcccattggggttgcaggcattctgtatgcccgcaaatatatgcccaacttcaccacgccgcgtcgcaagtttgacatgaccggcttctttctttttgggttaagtctggttttattttccagcggaatggaactgtttggcgaaaagattgtggcgacatggatcgcatccgccattattttttgcagtatcgttctactattggcctatatccgccacgcccgccgtcatccgacaccgttaatatcactatcgctgtttaagacacgcacattttccgttggcattgccggcaacctcgccacgcgtctggggacaggctgcgtaccttttttgatgccgttaatgctacaggttggttttggctacccggctctgatcgccggctgcatgatggcgccgacggctttgggttctattatcgcgaaatcgaccgtaacgcaggttttacgacgtttgggatacaggaagacgctggtcggcattacggtatttatcggtctgatgattgcccagttttcgtttcaatctcccgctatgccgatctggatgctcgtactgccgctattcattcttggaatggcgatgtccactcaatttacggcaatgaatacgattactcttgcggatctgacggacgataacgccagcagcggcaacagcgttctggcagttacgcagcaattgtctatcagtttaggcgtggcgatcagcgcggcggtgttacgtatttatgaaggttttgcgggcaccagtaccgtggaacagttccactatacctttatcacgatgggggcgatcactatcgtgtccgcgctgatgtttatgctgctaagagccaaagacggcaacaatctgattaaagaacggcataaatctaaaccgacccacgcaccgtcaaaaccggagtaagctgaagtcgctgttgttgcaaggcgggctgcgccatccgatgaatcaacacatcaatagcaagctcgcccaattcatctttcggctgatggatagtcgtcagcggcggcgtcatatagcgcgctagctcaatatcatcatagccaatgactgccatatcttgcgggatacgaagccccgcctgatatagcgcctgataggcgccgacagccatcgcatcgtttccggtaaaaaccgcttgcggtcgctgttgatgggcgagtaacgcctgcatggcgtcaaagccgccgccaaattcaaaatcgccggtgatctcatagccttgcggaatagccagccctgcgcgtttcatcgccgcccgatacccttccagccgcaaacgcgcaggcgttttgtccagcgggccggtaatacaggctattcgggtaaatcctttatcgataaggtgttgggtcgcaagatcgccgcctaacaacgaattatcctgaatgagatcgctatcgccctcaccatcaaacggcgaccagtccatcatgacggtaggaatagacggataacgttccatgatttcacgagaaggctgatgcgtttcagtacacagcagcagtaaaccgtctacccgtttttgcatcagcgtctttaggttgcggttcatccgttgctcatcgccttcggtattacacagcaccagactataaccgcgctcaaaacagcttcgctcaacgccgcgcaccagttcggaataaaaagggttggtactggcggtaatcagcataccaatcgtgcgggtctggtttaacttgaggcttcgcgccagcgtggaaggcgcatagttaagtgatttaatcgccgcttcaactttttcagtaatcgtctcactcacaaagcgatctttgttaataacgtgagagaccgtcgatgtagagactcccgccaggcgggcaacatctttcatagtagccaagcgttacccctgctgatgtaaaaacgcttctatctcttcgcgccacggaacggaaggttgcgcgcctttacgcgttacggcaatcgcggcggcggcatgggcaaagcgaatcgcttccggcaacggcgtctcctccagtatcgcggtgataaaggcgccgttaaacgtatctccggcggcaatggtatcgacagcctcaacgctaaatccaggaacgcggcgaccctcgccgtttacgctggcccagacgccacggcttcctaaggtaattaatacggttcgaatgcctttatcatgtaaaacctgcgcagctttcgcgacatcgtcgtcatttttcacacgcacgcccgtcagcttttcagcttccgtttcatttggcgtgatgatgtccaccagcgccagcagttcatccggtaactcacgggcaggtgccgggttaagcgcaacagtagtatgatgttgatgggcgattttcgccgccgccagtacgctttccagcggcgattccagctgcatcagtaacgcatccgcctgcgcgatacgttcacgttgcgcatcaaccaacgccggcgataacgcggcattcgctccggcatgaataccgatgacgttctcgccttcgccattaacgaaaatcagcgctaccccggtagactcgcctttaatgacgctaactggcgcgatatcaatacgatcgctgactaattgtttacgaatactgtcgccaatatcgtcatcgcccgtgcaggcgataaacgcaatatttgccccgctacgtcccgcagcaaccgcctgattcgcgcctttcccgccaaacgcgacctgataatggctaccggttaccgtttcacccggggtagggaaggactcaagattaaggatatgatcggcattaatgctgccaaggacgatgagattacctgcggttttcatattcggggttccacgtcaaagtgcgccaccggttagggtggcgcgtgccctgcttttctttttttacgttcacctcagcggaggctcgcgtatttctgtcgccatcaggccatagttgacccgtgtcgtttattactgcttgatgaccagtttcaggtcaaccggatatttggcctgaactttttcgcctttcagcaccttatccgctacttcaacgcctttggcgccgatttgatccggtaactgagcgatagtcgctgccagtttgccatcttttacggccttttcgccatccggcgtaccgtcaaatccaaccaccatcacatctgctttaccggcagtttgcagcgcgcgcagtgcgcccagcgccatttcatcgttctgggcgaagacagcctgaacatccggatgcgcggtcagcaggttctgcatgacgttcagacctttagtacggtcgaaatcggcaggctggctggccaggacattaaatttgtgggcggctaccgcctgctggaaaccttcgccacgctcacgcgccgcagatgttccggcaatgccttgcagctcaatcactttggcgccttcgccagcttttttcgcgatatagtcgccagcgatcttaccgcccagcacgttatcagacgcgatatggctgacgacatcgcctttggttgcctggcggtcaagcgtgataaccggaatcttcgcctggttcgccatcttcaccgcgttacccaccgcatcggagtcagtcgggttgatcagcaaaattttggtcccgcgaacggttaaatcctgcacgttcgccagctctttggcagggttgttctgggagtccagcaccaccaggttataacccagtttatccgcctctttttgcgccccgtcttttaacgacacgaagaagggattattgagggtagagatcaccagcgcaatggtgtctttcgccattgcattcgcgctcacggtggcgctcagcgcaacagcagataccagggtagccagttttttcatgttcatatttcagatgtcctgtagtcgttgttactgctttttgttgtctaccagtaccgccagcaaaatcaccaccgctttgacgatcatctggtaataggaggaaacacctaacaaattcaaaccattattaaggaagccgagaatcaatgcgccgatcaatgtcccaacaatgcgccctttaccacctgcaaggctggtgccgcccagcaccacggcggcaatagcatccagctcatagccggtacccgccgtcggctgcgcggaagagaggcgcgccacttcaatgatgcccgccagcgatgctgtcaggccgcaaagtgaatagacgataattttcactttgctcacgctaatgccagacagacgcgtcgccgcttcgttaccgcccagcgcgtagatatagcgtcccagacgggtgtgatgcagcatataccaggcggcgataaagacgatagccatgatccagaccggcgtaggaacgcccagcggacgaccgataccgaaccagccaaacagatcggcgttatcggtaaagccggtgttgaccgggctaccgtcggtgtaaaccatcgtcacgccacgcagtagcagcatcatcaccagcgtagcgataaacgcctgtacgcggcccttcgcgacgataacgccagtgacggcgccaatcgcagcgcccagcgccagcgcggcggcaaccgcgaccagcgcattcacttcaacgccgacgattgaagcggcaaccgcaccggtgagtgccagcagggaaccgacggacagatcgatccccgatgtcagaatcaccaacgtcatccccaccgccataatggcgttgacggaggtctgttgaagaatattgaacagattattaacggtaaaaaagttggggctcaacgtcgaaacaatcgcgatcaacaccagcagggcaatgagcgacttctgctcaagaagccacgctttagtgaaataacggcgaccagaaacagcctgggttgtcatcttttttactcctgattcacgcgattaagcttgcccactgcggcagccattaacacttcctgggtggcctgctcgcgagtaaattcaccgctgagatgcccttcatgcatgacgatgatgcgatcgctcatgcctaatacttctggcatctcagatgagaccagaatgatgctcaggccgtcggccttaaactggttgataagctggtaaatctctttcttggcgccgacgtccacgccgcgggtcggctcgtcgagaatgagcactttcgggcgcgtcatcaacccgcgggcaatcgccactttttgctgattaccgccagaaagcaggcctatcgcctgttccattgacggcgtcttgacgttgaacagacggataaaatcccccaccgcctgctgctcatctttgtgtttcaggcttccgccagcgcgactgaaataatccagcgcagtcagcgacatattctctttaactgacatgccgagcaccagtccatcgcgcttacggtcttcagagatataaacgatgccattggccagcccgtcctgcggagaacgcgtcaccactttgtgtccctcgagcgtcacgtaaccgctggttcgcggcatcgcgccgtacaatactttcatcagctcagtgcgaccggtgcccatcaggccggagatgccaagaatctcgccttttcgcagcacaaaagagacatcgttcacgcccggtccgcacagattatcgaccttcaggcgaatctcacccggcgcgttatccagatgcgggtactgatcttccagcttacgtcccaccatcatttcgataagagaatcttcggtcaacgtggccacttcacgctcggcgataaattgcccatcgcggaagaccgtcacgtcatcgcaaatttcgaaaatctctttcatacggtgagagatatagacaatgccgcgcccctgcgattttaattcgcggataacgcggaacagagagtcggtttcagtgtcggtcagcgcatcggtcggttcatccataatgatgactttggattcgaagctcagcactttggcgatttccaccatttgctgatcgccgatagagagttcgcccaccagcttatcgctcttaaagcgcagattgagtttggctaagaggtggtcggcttcggcatacatctttttccagtcgattttaccaaagcgattcacaaactcacggcccaggaagatgttttccgcaatggtcaactgcggaatcaggttcagttcctgatgaataatgccgatcccggcttcctgagacgatttaggcccattaaaggtggtctctttacccagccataacaacgatcccgcatctcgcgtatagatgccggttaatactttcatcatggtggattttccggcgccgttttcccccaccagcgccataacgcggccaggataaacgtttaacgcggcgccggagagagccttcacgccggggaacgctttatcgatccctttgagttgcagtaatgcgtccatagcggcctcagaaagtgacgccagcgcaaataatgacgttcgcatacggggaacactccccgctgcgaatcactgcctgactgtctgcagtcaattttttgaattgttcgtgtgtcgtataactaatttttatggtgtttccctggtgttgctgcagttgctcaaggtgagtgagcaacgtttcgtggagctgcggattctgttgtttgatttccgttgcaagaatcgccgcctcaacctgcatttcccaggtcacgacatccaccacctgcataaaagaaggtacgccctgggttagtgccatatcgatacgcgcagtgctattcgggatgggtaaacccgcatcacagaccaccagagtatcagtatgccccagacgggaaatgaccgacgagatttcagagttgagtacggtgcctttcttcatttttctgctccactagcgaaacgtttcgctggccgcagtgtaaccctggatgtgttcataaaaccatcatgacgtaacagaattgtgatcgccgtcgaaacgtttcgctagcggaaatcaggtgaagataatcgcccaatggcgattatcttgtgggaatctacggattggccaggccgggtaagccaatgcggcccccggcatgttgatgagaggttaaatctcgacctgcgtacctaactcaatcacgcggttaggcgggatctcgaactgatccggcgcgcgcagggcgttgcgttgcaacaacaaatacagcttgccgcgcagacgcaaataccacgggcgtttgccgacaatcaacgactcgtgcgacataaagaacgacgtttccatcatccgacagctaaggccttccagaccgcagcggtggaacacctcttcaacgtttagcgtttcgcgccagccgtagctggccaccacgcgccagaatgtcggagacaactgctcaatctgcacccggcgaacgttatgcacataaggcgcatcttccgtacgcaacgtcagtaagattacgcgctcatgcaacactttgttgtgcttcaggttatgcaataaagcaaaagggatcacactgagcgcgcgcgacatgtatacggcagtacccggcacccgaaccggcggtgacttctccagtgaagcaatcatcgcttccagcgaattaccgtgttcatgcatacgacgcaacagacggaaacgctcgctcttccaggtggtcatgatcgtgaacatgatcagacccaggctcagcggcagccaaccgccggacaacaatttgtcgaggttagccgagaacagcgggatatccacgcacaggaatgcgatgaggatcagcgcgacaaaatatttgttccagtgccagttcttacgcgccacggtcgtagaaagaatagacgtcagcaccatcgtgccggtcacggcgatgccataggccgccgccaggttgctggagtgctcaaagctaacaataacaaccacgaccgcgaaataaagcagccagttaacgaaagggatgtagatctgaccggactccatctcggaggtatggataatgcgcattggcgacaaatagccaagacgcacggcctgacgcgtcagcgaaaagacgccggaaattaccgcctgggaggcgatcaccgtcgccagcgcggccagaatcagcagcggaattaacgcccagtccggcgccaacaggaagaaggggtttttaatcgcttccggatgctttagtagcaatgcaccctgaccaaagtagttcagtactaacgacggcaataccacggtaaaccacgccaggcgaatcgggaacttaccgaagtgtcccatatcggcgtacaacgcctctacgccggtaatcgacagcaccaccgcgcccaacgcaataaacgatacggttttatattcaaggaaaaaacgtaccgcccagacaggattcagcgcatgtaacacttcgggattggcgataatactgcgtaggccaagtaccgccaggattaaaaaccaggtcagcatgatcggcgcaaagagttttcctaccattcccgtaccgtgcttctgaatcataaacaacagagtcagcacaataatggagagcgggacaatccaggtatccagctgcggcgcgacaatctccaggccttcaatcgccgacatcaccgaaatcgccggcgtaatgaccacttcgccatagaaaaagctgccgcctatcagtcccatgataactaacatggatgtggtgcgcgccgaggtattacgcccggcaagcgacatcagcgtcaaaattccaccttcacccgcgttatcggcgcgcatcacgaaggtgagatatttgatggaaaccacaaagatgagtagccagaagatcagcgacagaaaaccaaacacggcatctcgttcaacgccaaaaccaaactgaccggacaaacattcacgaagcgtataaagcgggctggtaccaatatcaccgtagacaaccccaatagctgcgagggtaatcgcaggcaacgattgcttattatcagtgctcatagactcatctttcgtttatacacgtcacccttcacgctacctccttgtcgactgcattcgcttaccccagtcacacgtttaagtcagtgccaggggattcactcctttgccgccttgatgtagtttgaatgaatgagtgtatagatatgaaatgtgtgcttagtcccttggcccacaaaaaagcgcacagtatgcacgattaatcataaaatcgtacccctaaatgaagccagattaacctggctcaaagaaaaataaacagcgcgtcagaagattacagccccggtggtgaaacgtctatactcgcaattagcatgatccatttgtcgaaaggacgcctctttattatggctcacccacatttattagcggaaagaatttcccgtctgagcagcgcccttgagaaggggctgtatgaacgtagtcacgccatacgcctgtgcctactggcggcgttaagcggtgagagcgtctttttgttgggcccgcccggtatcgccaagagtctgattgcccgccgcctgaagtttgctttccagcgcgcccgcgcttttgaatatctgatgacacgcttttccacgccggaagaggtgtttggcccgctctctattcaggcgctgaaagatgaaggtcgctatgaacgcttaacgaccggctaccttcccgaagccgaaatcgtttttctggatgaaatctggaaagccgggcccgctatcctgaacacattgctgaccgccattaacgaacgccatttccgcaacggcgcgtttgaggaaaaaatcccgatgcggctactggtggcggcctctaacgaactgcccgaagcggacagcagcctggaagccttgtacgaccgaatgttgattcgcctgtggctggataaagttcaggataaagccaatttccgctccatgctggttagtcagcaggatgagagtgataacccggtccccgcctcgttacaggttagcgacgaagaatatcaacagtggcaaaaagatatcggcgcgatttcactgcctgatccggtctttgagctgatatttactctgcgccaacagctggataatttgccgaatgcgccttatgtctccgaccgtcgctggaagaaagccatccgcctgttacaggccagcgccttctttagcggacgcgacgcggttgcgccgattgaccttatcctgctaaaagattgcttgtggtatgacgcgcagagtctgaatctcatgcaacagcaactggaaatattgatgaccggacacgcctggcagcagcaggccatgctgactcgcctcggcggtatcgtccagcgccgcctccagttgcagcaacagcaaagcgataaaaccgccttcaccgtcattaaagaaggcggtatgttcagccgtcgcccgcattacactttaccgccggaagccagtgcgtcaacgttgacgttattgctacaaaaaccgctaaaactgcatgatatggaagtgatccatattacctttgaccgcagcgcgctggaactttggctgaccaaaggcggcgagatccgcggcaaactgaacgggatcggctttgcccaaacgctgaatatggaagtcgataacgctcaacatccggtggtgcgcgacatcagtctacaaggtacccgtctggcgttaccgggagcggctgaagacagtatgcctgcggagatcaaacagcagctggaaacgttagaaaacgactggcgccagcagcatacccgcttcagcgagcagcaacattgcctgtttattcacagcgactggttagggcgcattgaggccagcctgcaggatgtaggagaacagatccgccaggcgcaacaatgctgacgctggatacgctaaataccatgctggccgtcagcgaagagggaatggtcgaagagatgatcctcgcgctactggcttccccacagctggtcattttctttgaaaagtttccacgtttaaaaaacgccgtgaccgccgatctcccgcgctggcgggaagcgctacgcagccgtcttaaagacgcacgcgttccgccggaactcacggaagaggtcatgtgttatcagcaaagccaacttctctctaccccacagttcatcgtgcaactgccgcaaatactggcgttgcttcatcgcctgcattcaccgtatgccgcgcaggcgaagcagttgacggagagcaacagtacctttacccctgcgctacacacgctttttttgcaacgctggcggttaagtctggtcgtgcaggccaccacgttaaaccagcaactactggaagaagagcgcgagcagttgctgagtgacgtacaggaacggatgacgctgagcgggcaactggaaccgacgttggcggaaaatgataatgccgcaggccgcctgtgggatatgagcgcgggccagcttaaacgtggtgattatcaactgatcgtaaaatacggcgaatttctcgccgcccagccggagctaatgcaactggcggaacaactgggacgttcgcgggaagccaaatcggtaccgaaaaaagacgcgccgatggaaacctttcgtacactggtacgcgaacccgcaacggtgccggagcaggttgacggtattcagcaaggcgatgatattctgcgcctgttgccgccagagctggcgacgctcggcatcaccgagctggaatatgaattttaccgccggttagtggaaaaacagctcctcacctatcgcctgcatggcgaagcgtggcgtgagaaagtgaccgaacggccggtagtacaccaggatgtcgacgagcagccgcgcggaccgtttattgtctgcgtcgatacttcaggctcgatgggaggatttaacgagcagtgcgcaaaagcgttctgcctggcgttgatgcgcgttgcgctggcggataaccgccgctgctttattatgctgttttccactgacgttgtgcgttatgaactctccggcccggaaagtattgagcaggccatccgctttttaagtcaacgttttcgcggcggcacggatatcgccagctgttttcgcgccattattgaaagaatgcagggacgggaatggtttgatgccgatgcggtggtcatttcggattttatcgcccagcgcttgccggatgacgtggtgagcaaagtgggagagttgcagcgtcttcaccagcatcgattccatgcggtggcgatgtcggcgcacggcaaacccggcatcatgcgcattttcgatcatatctggcgctttgacaccgggatgcgaagccgcctgctgagacgctggcgacgctaacggcttataaaatagcaggaatgctttcgcgaacctgcgcgggccatacgccgcactgcacctgaccaatatgcggcaattgcagcagcaacatcgtcagacgcgactgcccaatcccgccgccgatggtctgcggcatttcgccgcgcagcagcgcctgatgtcactccagttgcaggcgatcttcatcaccggtcaacgccagctgacgcatcagcgtatcggcatctacgcggatacccatagaggaaagctcaaacgcatcttccagcaccgggttccacactaggatatcgccgttcagaccagcgtagcccagctcagatgcggagctccagtcatcataatccggcgcgcgtacatcatggcggcggccatcgctcagtttaccgccgatccccaccaggaaaacggcgccaagttctttggcgatcgcgcgttcgcgccctttcgcatccagatccgggaaacgcgccagcagttcctgactgtgaacaaaatggatctgatccggcaggaacggcgccagaccaaactgtttatgcacttccgcttccgtcgccttaatgcctgcccatatagcctctactgtgcttttcagggtggaaaattggcgctcgccatcgcccatgacacgctcccagtcccactgatccacatagaccgagtggagcggagagagtcggtcttcatcggggcgaagggctttcatgtgcgtgtacagcccttcgcccgcgctgaagtcatgttgccccagggtttgacgtttccacttcgccagtgaatgcaccacttcgaactgggcgtcaggcaacgctttcacttttacctgcaccgctttttcacagccggacaaattatcctgcgtaccatcccctacgcgactcaggatcggcgcctggacctcaatcagacccagacgctcctctagctggcgagagaaatgtgatttcacgaagctaatttgacgttgtttggcaatgtaagcggttttcatttttttactcctgcgtcctgttgcctatgattaagcaacaaaacgagagcactattcaataatcaacagataaaaagctaacttcgattttgattcgttaaaaataatggctaaaatagagataatcattaatctgcataagaaaaagcgatggaaaattatcagatcgacaatctggaccgcggcatacttgacgccttaatggaaaatgcccgcaccgcctacgccgaactggccaaacaatttggcgttagccctggaaccattcatgttcgcgtcgagaaaatgaagcaggccgggatcattacgggcgcacggattgacgtcagccctaaacaactgggctacgatgtaggctgctttattggcatcatcctcaaaagcgccaaagactatccctccgcactggcccggctggaaagcctggatgaggtgacggaagcgtattacaccaccggtcactacagcatctttataaaagtgatgtgcaaatcaattgacgcgcttcagcacgtacttatcaacaagatccaaacaattgatgaaattcagtccactgagacactgatcgtcttgcagaacccgatcatgcgcaccatcaagccatgatcggcttttttaatcccacatttttccacaggtagatcccagctcgttcacagagtacaatgcagcctctttacctgagcgagcgatcaatggcagacattactcttatcagcggcagcaccctgggcggcgccgaatacgtcgcggaacatctggcggaaaagctggaagctgccggtttttcaaccgaaacggtgcacggtccgttattagaggatctgtcaacttccgggatctggctgataatcagctcaacgcacggcgccggagacattccggacaacctgacccctttctatgaagaccttcagacgcagaaacccgatctttccgcggtacgtttcggcgcaattggcattggcagtcgagaatacgacacgttttgcggcgcgattgagaaaatagaagcggaactgaaaggcgctggcgcaaaacaggttggggaaacactgaagatcaacatccttgaacatgagattccggaagatccagcggagatttggctcggatcctggattaatttactcaaataagtgtaaagatcgtgcgatctattgtggataaatatggtgaaaagcttggatcaaccggtagttatccaaagaataacctttgttcactttttgagttgtgtataagtacccgttttgatcccagcttatacgggccacgatcaccgatcattcacagctagtgatcctttccaacgcattgatctttattacaggatccgggttatccacagcctggtgcgatcctaataagagatcacaatagaacagatctctaaataaaaagatcttctttttaatagcccggatcccggggctttctccatcggctaaagttgagtagaatccaccgcccgggcttcaatccattttcacaccgcgttatgcgaggcaattaccatgttttatcaggatccttttgacgtcattattattggcgggggtcatgcaggcactgaggccgcgatggccgcagcgcgtatgggtcaacagactctgcttttgacacacaatattgacacgttggggcagatgagctgcaacccgacgatcggcggtattggcaagggacatctggtaaaagaggtggatgcgctcggcggtctgatggcgaaagcgatcgatcaggcaggtattcagtttaagatactaaacgccagcaaaggtccggccgttcgcgctacccgagctcaggcggatcgagtcttatatcgccaggcggtacgtatcgcgctggagaatcagccgaatctgatgatcttccagcaagcggttgaagatctgattgtcgaaaacgatcgcgttgtcggcgccgtgacccaaatggggctcaaattccgcgcgaaagcggtggtgctgaccgtcgggactttcctggacggcaaaattcatattggtctggataactacagcggcggtcgtgctggcgatccgccatccatcccgctgtctcgccgtctgcgtgagcttccgctacgcgtcagccgcctgaaaaccggcacaccgccgcgtattgatgcgcgtactatcgatttcagcgtgttggctcaacagcatggcgataacccgatgccggttttctcgtttatggggaatgcttttcagcatccgcaacaggtgccgtgttacatcacgcataccaatgagaaaacccatgacgtgattcgtaataacctcgatcgtagcccaatgtacgctggcgtgatcgaagggatcggcccacgctactgtccttcgatcgaagacaaggtgatgcgttttgccgatcgtaaccagcatcagatcttccttgagccggaaggactgacctctaacgagatttaccctaacggtatctccaccagcctgccgtttgacgtgcagatgcagattgtccgttccatgcagggcatggagaacgcgaagatcgttcgccctggttacgcgattgagtatgatttcttcgacccgcgagatctgaaaccgactctggaaagtaaatttattcacggcctgttctttgctggtcaaatcaacggtactaccggctatgaagaggctgcggcgcagggcttgctcgctggtctgaatgccgcgcgtctttccgccgacaaagagggctgggcgcctgcgcgttctcaggcttatctcggcgtgctggtggacgatctctgtacgctgggcaccaaagagccgtatcgcatgtttacctcccgcgccgaatatcgcctgatgctgcgtgaggacaacgccgatctgcgtctgaccgaaatgggccgcgagctgggtctggtggatgatgaacgctgggcgcgcttcaacgagaagctggaaaatatcgaacgcgaacgtcagcggctgaaatcgacatgggtaacgccgtctgcggaatccgctgatgaagtgaatgcgcatttgaccacgccactctcccgtgaggccagcggcgaagatctgttgcgtcgtccggaaatgacatatgcgcagctcacttcgcttgccgcattcgcgcctgcgcttgaagatgagcaagccgctgaacaggtggaaatccaggtcaaatacgaaggctatatcgctcgccagcaggatgagattgaaaaacaactacgtaacgagaatacgttgctgcctgccacgctggattatcgtcaggtttccggtctgtcgaacgaagttatcgccaagctgaacgatcataaaccggcgtctatcggccaggcatcgcgtatctccggcgttacgccagcggcaatctccattctgctggtatggctgaaaaaacaaggtatgctgcgtcgtagcgcttgataacactaatttggcgggggcgcttcgcttgcccgccctacaaatttgtaggcccgataagcgaaagcgcatcgggcatttgattattaacaggtaatgaccgtgctcaacaaactctctcgtctgctggctgatgccggtatttctcttaccgatcaccagaaaacgctgctggtcgcctacgttgatatgctgcacaaatggaacaaagcatacaacctgacgtcagtgcgggatcccaacgaaatgttggtacgccatattctcgacagcatagtcgttgcgccgtatctgcagggacagcgttttatcgatgtaggaacaggaccggggctgccgggcatcccgctggctattgttctccctgacgcgcatttcaccttactcgacagcctgggcaagcgggtacgttttctgcgtcaggtccagcacgaactgaaactggaaaacatcacgccggttcaaagccgcgttgaagcctatccctccgaaccgccgtttgatggcgttatcagccgcgctttcgcatcgttgaatgatatggtgagctggtgtcaccatctgccgggagagaaaggacgtttttatgccttaaaagggcaattgccaggggatgaaattgcctcactacctgacaattttagcgtcgaatctgttgaaaaattacgcgttccgcaactggaaggcgagcggcatctggtgattattaagtcaaacaaagtttaatttttatcaaaaaaaatagaaaaaacgacgcggcttgtgttaaaaatcgacaggtataacgcatttcagagttgttacatttaactctggatttacggtttcgtttcaacatgacaacgtcgcttcttttgttaaaacagagagtaatcaactttgtaaatatcagtctgctaaaaatcgaatcgaaaaatcacttttgcttgttaaatttttattataaatgtcaatggggcgtttttaaggtgtaagctggtatttttaaaacagtacctggttttacgcttaaatatcaaaaagatgaaaaggcatgaattgacacgtaaatgaattgcgtaagcatgaatatgtttaatgtgtgatctggtgcacgctttatcgccagtgttttcgcgctatttgcagttttgtacgatcgttcacactttagctaaaagttaaaaatgcgggccagagaaaaatatttaaacatttattcaccttttggctacttattgtttgaaatcacgggggcgcaccgtataatttgaccgctttttgatgcttgactctaagtcttaaagaacgttttatacgacacgcggcatacctcgaagtgagcaggagtaaaaacgtgatgcctgtgtcgctcgtgagtcgaaacgttgctcgtaagcttctgttcattcagtttctggcggtaatagcaagtggattgctgttttgcctcaaagaccccttctggggcatctccgcagtatgtgggggattggcagtggcactgcctaatatgttgtttatgatatttgcctggcgtcaccaggcgcatacacctgctaagggccgcgtgtcctggactttcgccttcggtgaagccttcaaggtgttagcgatgctggttttactggtggtggcgttggcggttttaaaggcggtgtttttgccgctgatcgttacgtgggttttggtgctggtggttcagatactggcgccggctgtaattaacaacaaagggtaaaaggcatcatggcttcagaaaatatgacgccgcaggaatacataggacaccatctgaataaccttcagctggacctgcgtactttctcgctggtggatccgcagaaccccccagccaccttctggacgctcaatattgactccatgttcttctcggtggtgctgggtctgttgtttctggtgatgttccgtagcgttgctaaaaaagcgaccagcggcgtgccaggcaagtttcagaccgcgattgagctgatagtcggctttgtgcatggcagcgtcaaagacatgtaccatggcaaaagcaagctgattgcgccgctggccctgacgattttcgtctgggtattccttatgaacctgatggacttactgcctatcgacctgctgccgtatatcgctgagcattggctgggtctgccggcaacgcgcgtggtgccgtctgctgacgtcaacatcaccctgtcgatggcgttgggcgtattcatccttattctgttctacagcatcaaaatgaaaggcatcggcggcttcgcaaaagagttgacgctgcagccgttcaatcactgggcgttcattcctgtcaacttaatccttgaaggggtaagtctgctgtccaaaccggtttctctcggtctgcgactgttcggcaacatgtatgccggtgagctgattttcattctgattgctggtctgttgccgtggtggtcacagtggattctgaatgtgccgtgggccattttccacatcctgattattacgctgcaagccttcattttcatggttctgacgattgtctatctgtcgatggcgtccgaagagcattaatttaccaacactactacgttttaactgaaacaaactggagactgtcatggaaaacctgaatatggatctgctgtacatggctgccgctgtgatgatgggtctggcggcaatcggtgctgcgatcggtatcggcatcctcgggggtaaattcctggaaggcgcggcgcgtcaacctgatctgattcctctgctgcgtactcagttctttatcgttatgggtctggtggatgctatcccgatgatcgctgtaggtctgggtctgtacgtgatgttcgctgtcgcgtagtaagcgttgcttgaattaagagcaatatcagaaggttaactagatagaggcattgtgctgtgaatcttaacgcaacaatcctcggccaggccatcgcgtttattctctttgtctggttttgcatgaagtacgtatggccgccgttaatggcagccatcgagaaacgtcagaaagaaattgctgacggtctcgcttctgctgaacgagcacataaggatcttgaccttgcaaaggccagcgcgaccgaccagctgaaaaaagcgaaagcggaagctcaggtaatcatcgagcaggcaaacaaacgccgcgctcagatcctggacgaagccaaaactgaagcagagcaggaacgtactaaaatcgtggtgcaggcgcaggcggaaattgaagccgagcgtaaacgtgcccgtgaagagctgcgtaagcaagttgctatcctggctgttgctggcgccgagaagatcatcgaacgttccgtggatgaagctgctaacagcgacatcgtggataaacttgtcgctgaactgtaaggagggaggggctgatgtctgaatttgttacggtagctcgcccctacgccaaagcagcttttgactttgccgttgaacaccaaagtgtagagcgctggcaggatatgctggcgtttgccgccgaggtaaccaagaacgaacaaatggcagagcttctctctggcgcgctggcgccggaaacgctcgctgagtcgtttatcgcagtctgcggtgagcagttagacgaaaacggtcagaacctgattcgggtgatggctgaaaataatcgtctgaacgcgctcccggatgttctggagcagtttattcatctgcgtgccgccagtgaagctacctccgaggtagaagttacgtcggcaaccgcattgagtgaagagcagctttcgaaaatcagcgccgcgatggaaaaacgtctgtcacgcaaagtgaagctgaattgcaaaatcgataagtctgtaatggcaggcgttatcatccgggcgggtgatatggtcattgatggcagcgtacgcggtcgtcttgagcgccttgcagacgtcttgcagtcttaaggggactggagcatgcaactgaattccaccgaaatcagcgaactgatcaagcagcgcattgctcagttcaatgtggtgagcgaagctcacaacgaaggtactattgtttctgttagtgacggtgttatccgcattcacggcttggccgattgtatgcagggtgaaatgatctccctgccgggtaaccgttacgctatcgcactgaacctggagcgcgactccgtgggtgcggtagtcatgggtccatacgctgaccttgccgaaggcatgaaggttaaatgtacgggtcgtatcctggaagttccggttggccgcggtctgctgggacgtgtggtaaacaccctgggtgcgccaatcgacggtaaaggtccggttgataatgacggcttctctgccgttgaagcgattgcgccgggcgttatcgatcgtcagtctgtcgatcagccggtgcagaccggctataaagccgttgactccatgatcccaatcggtcgtggtcagcgtgaactgatcatcggtgaccgtcagaccggtaaaaccgcgctggctatcgacgccatcatcaaccagcgcgactccggcatcaaatgtatctatgtcgctatcggccagaaagcgtccaccatctctaacgtggtgcgtaaactggaagagcacggcgcgctggctaacaccattgttgtggtggcgaccgcgtccgaatccgctgcgctgcaatatttggcgccgtatgccggttgcgcaatgggcgaatacttccgtgaccgcggtgaagatgcgctgatcatttacgatgacctgtctaaacaggctgttgcttaccgtcagatctccctgctgctccgtcgtccgccaggacgtgaagcattcccgggcgacgtattctacctccactctcgtctgctggagcgtgctgcgcgtgttaacgccgactacgtcgaagccttcactaaaggtgaagtgaaagggaaaaccggttcactgactgcgctgccgattatcgaaacgcaggcaggtgacgtttccgcgttcgttccgaccaacgtaatttccattaccgatggtcagatcttcctggaatctaacctgtttaacgccggtattcgtcctgcggttaacccgggtatctcggtatcccgtgtaggtggcgcagcccagaccaagatcatgaaaaaactgtccggaggtattcgtaccgcgctggcgcagtatcgtgaactggcggcgttctctcagtttgcatccgaccttgacgatgccacccgtaaacagcttgaccacggtcagaaagtgaccgaactgctgaaacagaaacagtatgcgccgatgtccgtcgcgcagcagtctctggttctgttcgcagcagaacgtggttatctggcggatgtcgaactggcgaaaatcggtagcttcgaagccgcactgctggcttacgtcgaccgtgatcacgctccgctgatgcaagagatcaaccagtccggtggctataacgacgaaatcgaaggcaagctgaaaggcatcctcgattccttcaaagcaacccagtcctggtaacgtctggcggcttgccttagggcaggccgtaaggcattgaggagaagctcatggccggcgcaaaagagatacgtagtaagatcgcaagcgtccagaacacgcaaaagatcactaaagcgatggagatggtcgccgcttccaaaatgcgtaaatcgcaggatcgcatggcggccagccgtccttatgcagagaccatgcgcaaagtgattggtcaccttgcgaacggtaatctggaatataagcacccctacctggaagagcgcgacgttaaacgcgtgggctacctggtagtgtcgaccgactgtggtttgtgcggtggcttgaacattaacctgttcaaaaagctgctggcggatatgaaggcatggtccgataaaggcgttcagtgcgaactcgcaatgatcggctctaagggcgtgtcattctttaattccgtaggcggcaacgttgtcgctcaggtgacaggtatgggggataacccttctctgtccgaactgatcggtccggttaaagtgatgttgcaggcctacgacgaaggccgtctggacaagctttacattgtcagcaacaaatttattaacaccatgtctcaggtgccgacgatcactcaactgctgccgctgccggcgtcagaagatgatgatctgaagcgtacagcctgggattacctgtatgaaccagacccgaaagcgctgctggatactctcctgcgtcgttatgtggagtctcaggtttatcagggcgtggtagaaaacctggccagcgagcaggccgcacgaatggtggcgatgaaagccgcaaccgataatggcggcagcctgattaaagagctgcagttagtatacaacaaagctcgtcaggccagcattactcaggaactcaccgagatcgtctcgggggccgccgcggtttaaccaggttatttcgtagaggatttaagatggctactggaaagattgtccaggtaatcggcgccgtggtagacgtcgagttccctcaggatgccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagctacgctgggtcgtatcatgaacgtcctgggcgaaccggtcgacatgaaaggcgagatcggcgaagaagagcgttgggcgattcaccgcgcagcgccttcctacgaagagttatcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttatccgtaacatcgcgatcgagcactccggttactctgtgtttgcgggcgtaggtgaacgtactcgtgagggtaacgacttctaccatgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgacgtactgctgttcgtcgataacatctatcgttacaccctggccggtacggaagtatccgcactgctgggtcgtatgccttccgcggtaggttaccagccgactctggcggaagagatgggcgttctgcaggaacgtatcacctccaccaagaccggttctatcacctccgtacaggcggtatacgtacctgcggatgacttaactgacccgtctccagccaccacctttgcgcacttagatgcaactgtggtactgagccgtcagatcgcatccctgggtatctacccggccgttgacccgctggattccaccagccgtcagctggatccgctggttgttggtcaggaacactacgacaccgcgcgtggcgttcagtccatcctgcagcgttatcaggaactgaaagacatcatcgccatcctcggtatggatgaactgtctgaagaagataaactggtggtagctcgcgcgcgtaagatccagcgcttcctgtcccagccgttcttcgtggcggaagtatttaccggttctccgggcaaatacgtctccctgaaagacaccatccgtggctttaaaggcatcatggaaggcgaatacgatcacctgccggagcaggcgttctacatggtcggttccatcgacgaagccgtggaaaaagccaaaaaactttaacgccttaatcggagggtgatatggcaatgacttaccacctggatgtcgtcagcgcggagcaacaaatgttctccggtctggtcgagaaaatccaggttacgggtagcgaaggtgaactggggatctacccggggcacgcgccgctgctcaccgccattaagcctggtatgattcgcatcgttaagcagcacggtcacgaagagtttatctatctgtccggcggcattctggaagtgcagcctggcagtgtgaccgttctggcggataccgcgattcgcggtcaggatctcgacgaagcgcgagccctggaagcgaagcgtaaagccgaagagcacattaagagctcgcacggtgacgtggattacgctcaggcgtctgcggaactggccaaagcgatcgctaaactgcgcgttatcgagttgaccaaaaaagcgatgtaacaccggcttgaaagcataaaaccagtctgattgcggactggttttttttatcctctcaatttttattcgataaactagcaacgacaaaaacaagcggctgaaggcgatgcgttttcagcgacagcgctgttttcattaaatccttctttctgtcattggcatctgcacattgtgcgaagaaggaaggaatggatgcgtttttattgcataaaatgagggattattactatgtcatttcagccatcctttgcggggccacaacccgactcaaggattgatcgtactacctttattcgtcgcgcttatcttcatctcgccgtcgccatcgtcggttttatcgtgttgagcgcggcgtggagttttatagggggcggggagtatgcgcttgatgtgctgctggctggtggaagatatagctggttggttgttctcggcgcttttatgctggtgggaatgctggcgacccgtctggcggataatgcggggactaatcaaacgcaacttatcgggctggggatttatgtgttggcagaatccctgatttttgcccccctgttaacggtggcggcgtatattaacccgtcgagcattggcgcggcggcaataacgcccctgttgctggttggcggtctgacgtttaccgcgttttccataaaaaaagacttttcttttctgcgctcgtttctgactatggctggattcattgcttttggcgcgattattgccagcgtcatctgcggcttttcgctgggcgtctggttttctgcgctaatggtactgctgtgcgccgggtttatactttacgacacttctaacattattcaccattaccctaccgatcgccctgctggcgcggcattacatctgtttgcttctatcgcgaccatgttctggtatattttgcggatttttatgtcgcgtaattaagtaaaaaatacgcgcaacggaaaaccagcggcctctgtcgctggtttttgcttttctgactcccctgcgctttatttcgttatcttctttatttatggagtaaaaaaacagcaaaaacatcggactacgttgccaatacgcgggtgtttttacttttcaggagacaagaggcgcggtaatgaacgaaaatgattcattagcaggcggggattttatcccggtgagcgttttatccttcttccattttacgatgaaaaaaatgtagtattttcaacgtgaaacagtataaattcgttctcaaattacagtcaggacgcgtatgttaaatagtgctatgagcgtagtgatccttgccgcaggtaaaggcacgcgcatgtattccgatattcctaaagtgctgcacacgctggcgggtaaacccatggtgcagcatgtcattgatgcagctactaaattaggggccgcacaggttcatctggtctatggccacggtggcgagttgttaaaacagaccctgaaagatgacaagctgaactgggtgcttcaggcggaacagttgggaacaggtcacgcaatgcagcaggccgcgcccttttttagcgacgatgaagatattttaatgctttacggcgacgtgccgctgatttcggttgaaaccttacagcgcctgcgcgatgccaaaccgcagggtggtattgggttattaaccgtgaagctggacgatccgagcggctatggccgtattacgcgtgaaaacggtaaagtgaccggcatcgttgaacataaagacgccactgatgaacagcgtcagatccaggaaattaacactggtattctgatcgccaacggcgcggacctgaaacgctggttgtctaagctgactaacaataatgcgcagggtgaatattacatcacagatatcatcgcgctggcttatcaggaaggacgggaaatcgccgcggtgcatccggctcgcatcagcgaaacggacggcgtgaataaccgtctacagctttctcgtctggagcgtatttaccaggccgaacaggcggagaaactgctgttatccggcgttatgttgcgcgatccggcacgttttgatctccgcggcaccctttattgtggaatggatgtcgaaattgacgctaacgttatcatcgaaggttatgtaacgctcggtcaccgcgtgaagatcggcgcgggctgcattattaaaaacagcgttattggcgatgactgcgaaattagcccatacagcgtggtggaagatgcgcatctggaagcggcctgcaccatcggcccgtttgctcgcctgcgtcccggcgctgagctgttagcgggcgctcacgtcggcaattttgttgaaatgaaaaaagcgcgtctgggtaaaggttctaaagccggccatctgacctacctgggcgatgcggaaattggcgacaacgtgaatattggcgcggggaccatcacctgtaactatgatggcgcgaacaaattcaaaacggttattggcgacgatgtgtttgtcggctccgatacccaactggtggcgccggttactgttggtaaaggggccaccatcgccgcagggactaccgtcacccgtaatgtagccgacaatgaactggtattaagccgcgtgccgcaggtgcataagcaaggctggcagcgtccggtgaagaaaaagtgattttgtaggccggataagcgtcagcgccatccggcagaccggagatgagaggataaaataatcctccgctccatgagcagtacttataaaaataaccccactctctacaaggctcggggcgcccgcaacgacgggcatacaggtcagcgacaacgcatggcgtaatgccataatcaggaaataaaactatgtgtggaattgttggcgctatcgcgcagcgtgatgtagctgaaatccttctcgaaggtttacgtcgtctggaataccgtggttacgactctgccggtctggccgtggtggatgcagaaggtcatatgacccgcctgcgtcgcctcggtaaagtccagatgctggctcaggcagcggaagaacacccgctgcatggcggcaccggtattgctcacactcgctgggcgacgcacggtgaaccttcagaagctaacgcgcatccgcatgtttctgaacacattgtggtggtgcataacggcatcatcgaaaaccatgaaccgctgcgtgaagcgttaaaagcgcgtggctataccttcgtttctgaaaccgacaccgaagtgattgcacacctggtaaactgggaactgaaacaaggtggtactctgcgagacgcgattttgcgtgcgatcccgcaactgcgtggcgcatatggcacggtgatcatggatacccgccatccggatacgctgctggctgcccgttcaggtagcccgctggtgattggcctgggtatgggcgaaaactttatcgcttctgaccagctggcgctgttgccagtgactcgtcgctttatcttccttgaagagggcgatatcgctgaaatcactcgccgttcggtaaatatcttcgataacaccggcgcggaagtaaaacgtcaggatatcgaatccaatctgcaatatgacgcgggcgataaaggtatttaccgccactacatgcagaaagagatctacgaacagccgaacgcgatcaaaaacacccttaccgggcgcatcagccacggtcaggtggatttaagcgagctgggaccgaacgccgatgatctgttgtcgaaggttgagcatattcagatcctcgcctgcggtacgtcttacaactccggtatggtttcccgttactggtttgaatcgctggcaggtattccgtgcgacgttgaaatcgcctctgaattccgctatcgcaaatctgccgtgcgccgtaacagcctgatgatcacgctctcccagtctggcgaaacggcagataccctggctggcctgcgtctgtcgaaagagctgggatatttgggctctctggccatttgtaacgtgtcgggctcttcgctggtgcgtgaatccgatctggcgctgatgaccaacgcgggtacggaaattggcgtagcatctaccaaagccttcaccacccagttaaccgtgctgttgatgctggtggcgaaactgtctcgcctgaaaggtctggatgcgtccattgagcatgatatcgtgcatggcctacaggcgctgccgagccgtattgagcagatgctgtcgcaggacaaacgcatcgagctgcttgcagaagatttctctgacaagcatcacgcgttattcctcggtcgtggcgatcaatatccgattgcgctcgaaggcgcgctgaagctgaaagagatctcttacattcacgcggaagcctatgctgcaggcgagctgaaacacgggccgttggcgctgattgacgccgatatgccggtgattgtggtggcgccgaacaacgaactgctggagaaactgaaatccaacatcgaagaagttcgcgcgcgtggcggtcagttgtacgtcttctccgatcaggatgcgggttttgtgagcagcgacaacatgcacatcattgagatgccgcatgtggaagaggtcattgcgcctatcttctacaccgttccgctgcaactgctggcgtatcacgtggcgctgattaaaggcaccgacgttgaccagccgcgtaacttggcgaaatcggtgacggtagagtaagtcaaatgttgtaccaaaaaaaaggctgtcgatagacggcctttttttatgagttttttgaacaaaaataaaaaatatttacgggagatgagaataacggaatagtggttgataaataaacaattgtttgattgttaaactaaaaaataaattttttcctaaaaatatgtacgttaaatgtctctgactttagtgtttgtatataattatttatattctttggtttagtaaaaataaaattttaaaaagataatattgcctgttatttcactcaaacaattccattgtgtaaatttgactgcttgatatttattttctcgggagtagtattcgcttccgttgtagacacattgtgttttatttatttttaaatgaaacatcgggatatataatatatcaatagagttataatgaaactgaatttaattgccagcgctctggttctgtcttctactatgctggtaggtaatgcaatggcatctgatggcaccgttcacttccttggtgaagtggttgacagcacctgccaggttacgccacaaaccgctgatcaaaacgttaatttaggcaaagttaacaaaacggcatttgctggcgtgggaagtaccgctgcgcctaccgagttccatatcgacctgaccgggtgcccggctacgtatactaaggctgccgttcgttttgatggtaccgaagcttccaacagcgatggcgacctggctatcggcaaccctgctaatggcgatgccccgggtgattacaccggtgacggcgctgccattacagcatctggcgtagcgatccgtatttacaaccgcgcggataactcacaagttaaactgtacaacgattctgcgtatagcacgattgataccacagcgggtacggcttctatggagtttatcgcgcgttatatcgccactgacgcaaccgtcactgcgggtactgctaacgcagattctcagttcactgtcgaataccaaaaataagattcgctcttcttaaacgtcttttattaatttattgacgcctgccattgtgaacaactgtagttgtataaatgcccggcgtcttttttatccagggatgagtttgtctatgtttgctcgtggaataaaaatagttattctggcactcctgtgccttaatcttccctctgcttttgcaggtattgtggtcggtggaactcgcgtcatttttcatggcaacgatcctgactctactatttctatttacaataaagaagttgatttgccttatctaatacaagtatgggttgatcctttcagtaaggatgataagagcaaaccaccttttaccgtcattccgcctgtttctcgtcttgagccgagtcaggaaaaagtgctgcgcattattaaaacagcgggtgagttgccaaaggatcgcgaatctgttttttggtttaatgtgaaaaacattccgccatccagtaaaaataaagatagcagtacgcttgagatcgcaattaaaacgcgtatcaagttattctggcgcccggcctctattacgcttatcccggaaaaggcggtagctaaagtcaaatggtatcgacagggaagtaaactggttgtagaaaataatagtcctattcatatgaatatcatggatgtctctgtagacggtaaagatgttccattgaatatgataaagccttttgaaaaattaacgttggatttacctactggtgttacggggcacgctttagcctggcgttttattaatgattacggcgcgattagtagccctgttaagcaagcgctttagttttgcgataaggatatcttgatgattcaccctcgtctttgcctcgtcttgatttcaggtgcttatctgagtatcgttttcccgacaatggctagggaaacgctatttaaccctggtttgctggaaattgatcaccccgtggacgtggatattcatcagtttaaccgttccaacgcgttgccgccgggcgattataaggtcgatatcgtcattaacgggaaactgtttgaacgacgggatgtgacctttgtgcaggatcaaccggatgccgaactgcatccctgctttgtcgcggttaaggatgtattgtcgtcgtatggtgttaaggtagacgcggtgaaaggcttgcaggatgtcgataatacagcctgcgtgaatcccgttccgttaattgatggcaccacctggttattagatgcgaataagctggcgttaaatatatctgttccacagatctatctgaacacggcggcctatgactatatcagcccgtcacgctgggatgagggcatcaatgcgatgatggtcaattaagatttttccggatcgcacacggtaaagtctaattacgacaatgggaacgatgactcttattatctgaacctgcgtaacgggattaacctgggagcatggcggttgcgtaactacagtacgctgagcgccaccggcagcgacacggaatatcactccatcagtagctatgtccagcgcgatatcgccgcgctgcgcagccagattatggtcggcgacacctggacggcgagttatgtctttgatagcgcccagatccgcggggtcagactctataccgacgatgacatgctaccgtcgagccagaacgggtttgcgccagtggttcgcggggtggcgaaaagtaacgccaccgtcatcatccggcagaatagatatgtcatttatcagtcagccgtgccgcagggcgctttcgagatcaccgacctgaacaccaccagcggcggcggcgatcttgatgtcaccataaaagaagaagacggcagcgagcagcactttacccagccgtacgcgtcgctggcgatactgaagcgtgaaggccagaccgattttgatattagcgtcggtgaaatgcgcgatgaaagcggatttacccctaacgtcgttcaggcgcaggtgttgcatggcctgccatggggattaacgctctatggcggcacgcaggttgcggaagattatgcttccgccgcgcttggtatgggtaaagatatggggtcgatcggggccgtatcgtttgatgtgacccacgcccgttcacactttgacgatggtgataatgaaagcggccagtcctggcgttttctctactccaaacgttttgatgataccgacaccagtttccgtctggtggggtaccgttattccacggaaggctattacaccctcggcgagtgggcatcgaggcaggacaacagctctgatttctgggagacgggcaaccgccgtagccgcgtggaaggaacctggacgcaatcatttggccccggttttggcaacatttatctgacgttaagccgtcagcaatactggcaaacggatgaagtcgagcgcctggtgcagtttggctatagcaatagctggcggcgaatttcgtggaacgcgtcgtggaactataccgactctgcgaatcgttcttccggcagcaataataaaaacgacaacgatgacagcgatcacgaacagatattcatgctgacggtttccatcccgctttcaggggcgaaggagagcagctacgttaactactcgatgacgcaaaataatcataacgacagcacaatgcaggctggcgttggcggcacgttgctggagggccacaatctttcctataacgtgcaggaatcctggaccagtacgccggaggatacctatggtggtaacgccagcatggggtatgacggtacttatggttcagtaaacggcggttatgcctggagccgtgattcacaaacgctgaactatggcgcccgcggcggcatcctggttcacagcggcggtgtgaccttctcgcaggagttgggggaaaccgtcgcgctggtggaagcgccgggtgctgatggccttaccgtagaaaacacgactggggttgctacagactggcggggctatacggtgaaaacgcagcttaacccgtacgacgaaaaccgcatggcgattgacagcaactattttgccaaagccaatattgagctggataacacggtagtcaatctggtgccaacgcgcggcgccgtggtgaaagcggcgtttgtgacgcatgtcggttatcgcgtgttgtttaatgtgatgcaagtgaatggcaaacctgcgccgtttggcgcgatggcgtcggcggagctggattccggaacggtaaccgggattgtcggcgataacggcgaactctatttatcggggatgccggaaaacggtcatttcactctaagttggggcggtgatgaatcaacaacatgtgccgttaattatacgttaggtcataaaacagagaatgctgaactggtgcagcaagccgtcacttgccaataaggaatttaattatgcgcttatggacaataatattattttcatgctttatggttcttatttcgcctgtttgccgggctggcgatggcatttgtcatgcggttaaagggacttatatttataaccttaatctcaatgacgcccggattcccgcagaaaaaaataaagccggaacagaggtcagggatctggagacattaacatcgtcagaatcatataaagttggctgtagctgtttgacccatttttcatcgacgtttcgtgaagtctattataccgctcgttcgccgctgagtattgataccaccagaaatggttacacctactatacgcttaacgataacctaagtattgcaacgtcgattgctgttcttggacgaggctttattgcggttccctttgaggctgaacctaatgtagtaaaagatgggatgaattgttataccgataccgttgagggcaatctcgcaacgttatataccgggtcggaggtcaaggtctctttccttatcaataaaccgtttgtcggtcaggttgccattcctggcacgattgtggctaatttatacggggggcttgatgccagctcctcgactgccagtaccgacaaattggcggaagtcagaattgttggcgatatcgtggcgccgcagagctgtgaaattgattccggccaggtgatagaggtgaatttcggtaagatcccggttgcggatttctcgacaacgcaaggcaccgctgctgcgggtcataaagtgactaaaacggtacaggtgaaatgtaccggaatgttggatgagaatatcgtctattcgacatttaatgctgatcccgttgattccagcgcaaatatgatgaaagttctgggtaatgatgatgtcggaattatgatttatgacaaatgggatcggatggttaaggtgacaggcggaaaaatggatatggatatgggcgtcaataatggcggcgccgagactaactcattgactttttctgccgcgcctgccagcgcgacgggagcgcggcctcaacctggtacatttgaagcttacgccacgatcacgctggaaataacgaactaatctaattacaaaataagtcatatcaatgaactacggccctggctcaatccaggtggatcggaaatcaaaccatcccaggttattcaggtggatccccctggcccggtcggggcttttgagtcgcatccagtggtgaaaaagcggctgtagccagcctgaacgggtggtttccctgaccagttgttccgcgctgatggtttcggcatgccactgggtttcccattgggccagcagcgcatcatccccaccgctgatggcgtggcgcagtaaaggggagcccagtagccatgtaccgacgttccactcttcgggaatggggaaattgaccgtccccagccagagatccacattggttttgccattcgcccagtcatcataattcagctcaacgccctcaagtaaaatgccctgctggcgcatgatctcttgcataatatccaggagcattggaaattcagggtgctgatcgtgataggccagacgaagttttgcgtagggcgacgacgagataaaaggtgaacaggccgggcccgcctcaatagtatgaaaccaggaggacagcaggctgccgcccggtacccagaaggggcgaattgcctcactcagatgctggagtaaggcgtaagggctgagagtttcccgcagccagcggcgatgttcggcggtatgccagtgcggggagcggctgtcgcataataaaaaatatcctccacgctcaagaaacatctcgcgcaggttgtcagaaggtttgcctgatacctggctaagccgtccggaaacgtaatcctcatcgctcaggctggaactgagccaggctgccgtgtcgttatccgacagcgattccgccaggttgtctgtctccgttaaattcggccagataaagacctccacttcatccagcagcccgcgcaggccgaaatagtggtcaaaggccttcatttgcagatgaaagccattgttttccaccacctcataagggccagtccccacaggatgtgccgggaaatcagcgcgttgtgtatggtcaggcggtaggatcatggcatcaatatggctgagcagcagcggcagtcggttatccgggtgcgccagcgtaatttcaaggctcagcggcccggtggcctgaatggtctgcaagtgcgagaacaacggcagcttagcgctgcgggtcagtgaagcgataaccgcgtcgatcgtcagctcctgaccatcatgtcagaggacggcggggcgcagataaaaacgccagcgcagtggatcaatctgccgccagtggtgggcaagatcggcttcgacttcacctttttcctcatttatgcgcgtcaggccgctaaaaatctgcctgaccagatgctgctcagagcgacgcaacggtatgccggggcacagcgacggcattgtccggtaataggggatgcacagccgctgatagtctgcccgcacgctatagcccagttttgagcgcagcagttgcgccacctggtgcttatttttacccagcagctgaatggcctgatcaacatgaccagactccagcaactgctccgccttttcgcttaacagctgttctggtttatagcgcaggtgaagccgggcgcgatgcccacgtccggcctgtgattgccagatgagccactttgcctcctgcatctgaagcaacagattacgcatatgccgccgggtgcagaacaacacatccgccagctcctgtagcgtcacgctaacgggcttatcgccatagtgctggagtagctttaagtatttttgttcagtgtgccgggttgccataaaagatgaaatttcccgaacgggaatgagcaatttttaatatcccctttttagccgatgattttctctatcgcaacttctatgaggattcatcatgacaaagcgcattaataaagacactcaggtctgcatgtccctggctgcacgcccaagtaacttcggtacacgctttcacaactatctgtacgaagcgctggatctcaattatctctacaaagctttctcgccgaccgatcttacgcaggccattagcggcgtgcgcgggctggggatacgtgggtgcgcgatctctatgccatttaaggaagcctgcattccgctggtggatgaactggatgcttccgctaaggcgtacaacaccgattacattgcaatagctcgcttgctggcgaattacaaggtctctcccgaccaggtgtttgctttgcgtggcagcggtggtatggcaaaggcggtggcctgcgcgctgaaggatgcggggtttacccgtggttatattgtcgcgattgatgaagcgtcaggtaaacaactggccgaactctatggctatgaatggcgcccggataccgacggtattgaagccgatttgttaattaacgccacgcctatcggaatggctggcggtaatgatgccgacaaactctcttattccgaacaagaagtggataaggcgagcgttatctttgatgtggtggcgctaccgcccgtcacgccgctaatccgctacgcccgtgaacgcggtaaaaccgtgattatcggttccgaagtgtttgctattcaggccgtggagcaatttgtcctttataccgggattcgcccggatgacgcactgttccagaaagctgcggcctggtcacgtctgtaacattttttcccgctttttctttaaattaaaagaacagggtatcctactatgactaaaaaaattgttgctgtgacggcctgtccgacgggcgtcgcccatgcctttatggctgccgaagcgctggaaattgaagctcgcaagcgtggtgactggatcaaggttgaaacccgcggttccgtcggggcgaagaacacgctgaccgcggaagagatagcgcaagcggatgtggtgattatcgcggcggatattgagctggatctgtcaggctttgttggcaaaagactctatcgcaccagtaccggcgcggcgctaaaaaagagtgcgcaggaaatggataatgctttcaatagcgccgaggtctatcaggggagtgccgggcgctcttcttcagctagtaaaacagagctacccggcgtttataagcatttaatgaccggcgtatcccatatgcttcctttggtggtggcgggagggttatgtatcgcgctctcttttgtcttcggtatccaggccttcaatgagccgggcacgctggcggctgcgttatttcaaatcggtggtaaggcggcctttgcgctgatggtgccggtactggctgggtttattgccttctcaattgccgatcgtccgggtctggccccggggcttattggcgggatgttggccagcctgtgcggtgctggtttcctgggagggattgtggccggttttctggccggttacagcgtacggtttctggcgcaaaatattaagctgccagcgtcaatggaagcgcttaagccggtactggttctgccgctactgtctacgctgattaccggcctaatcatgatttacgtggtgggtggccccgtttctgcggtgatggaagggctgacgacgttcctggggaatatgacctctacgaatgctatcttgctgggaatgttgctgggcgcaatgcaaggttttgaccttggtgggccggtgaataaagctgcgtataccttcggcgtcggtttactggcttctcattcctatatgccgatggcggccattatggcggcagggatggtaccggcattagggatgggcgtcgcaacctgggcggccagagcgaaattcactgcctctgagcatgaagcgggtaacgcatcctttatcctggggctgtgctttatctctgaaggggcgattcccttcgctgcgcgtgacccgatgcgcgtcatcccttccacgatggtcggtggcgcaatcgccgggggactgtccatgtatttcggttgtacactgatggcgccacacggtggtctctttgtcctggcgatcccgcatgcggtagaacatgtgatgcagtacctgctctcgattgccctgggcacgattgtctgcggcctgatgtacgcgctgttgaaaccgtctgcggttgcgcaaacagtttaattcatctccccctgcaggctggtctggtgtctccccgggccagcttttttatttccattgtcatcaaaccgtcataatcaagacatataactgtcatcaatttgtcctattttgctcatcgtagcaactcaaacaacgatttaccgaaaccgtgcaggagacattatgaaagttatgcgtaccactgtcgcaactgttgtcgccgcgactttatcgatgagcgcgttctctgcctttgcagcagcaagcctgacaggtgccggtgcaacgtttcctgcgccggtgtatgccaaatgggcggatacctaccagaaagaaaccggtaacaaagtcaattaccaggggataggctcttccggcggcgtgaaacaaattaccgcgaataccgttgattttggcgcttccgatgcgccgctgtctgacgaaaaactgaatcaggaaggcctgttccagtttccgacggtgatcggcggcgtggtgttggcggtgaatattccaggcctcaaatccggcgaactggtgctggatggtaaaacgctgggtgacatctacctcggtaaaatcaagaagtgggatgatgaagccatcaccaaactgaacccaggcgtgaagctgccctcacagaatatcgttgtggtgcgtcgcgctgacggttccggtacctccttcgtgttcaccagttacctggcgaaagtcaacgacgagtggaaatcgaaagtgggcgcgggttctaccgtgaactggccaaccggtctgggcggtaaaggtaacgacggcatcgcggcatttgtacagcgtctgccaggcgctatcggctacgttgaatacgcttacgctaaacagaacaacctggcctacaccaaactggtttctgccgacggcaaaccggtaagcccgacggaagagagcttctctaatgcggcgaaaggcgcagactggagcaaaaccttcgcgcaggatctgaccaaccagaaaggtgacgatgtgtggccaatcacctccaccacctttatcctggtccacaaagcgcaaaagaaacctgagcagggtgctgaagtgttgaagttcttcgactgggcctacaaaaatggcgctaaacaggcgaatgatctggactacgccagcctgccggataacgttgttgatcaggttcgtaccgcctggaagaccagtataaaagacagcaacggtaaggcgctgtattaattaacgaattggcggatggcgctacgattatccgccctacggtttcgaccgcaggcccacgttgtaggccggataatcgtagcgccatccggcaggggcaacgtcgtaaaatgcgtttaatggaaagagtaatttatggctgcaaccaagcctgcttttaacccgccgggtaaaaaaggcgacatgattttcagcgcgctggtaaaactggctgcgctgattgtgctattgatgttgggcggtattatcgtctcattgatcatctcctcctggccaagtattcagaaatttggtttctcatttctttggactaaggagtgggacgcgccaaacgatatctacggcgcactggtgcccatttacggcacgctggtaacctcctttatcgcactgctgatcgccgttccggttagtttcggcattgccctgtttttaaccgagctggcgccaggctggctgaagcgtccgctcggcatcgccattgaactgctggcggcaattcccagtatcgtgtacggcatgtgggggctgtttatcttcgcgccgctgtttgcgacgtacttccaggagccggtcggcaatattctttccaacattccgtttgtcggcgcgctgttctccggcccggcctttggtatcggtattctggcggcgggcgtcatcctcgccatcatgatcatcccctacattgcggcggttatgcgcgacgtcttcgagcaaacgccggtaatgatgaaagagtccgcttacggtatcggctgtactacctgggaagttatctggcgcatcgtgctaccgttcaccaaaaatggcgtgatcggcggcattatgctggggctgggccgtgctctgggtgaaacgatggcggtcacttttatcatcggcaacacctaccagctcgacagcgcgtcgctgtatatgccgggcaacagcatcacttccgcgctggccaacgaattcgctgaggcggaatcgggtctgcacgtggcagcgttgatggagctggggctgatcctgtttgtgatcacctttatcgtcctggcggcgtctaagttcatgattatgcgtctggcgaagaacgagggagcacgttaatggctacgcttgatatgcagaacaccgcgcagctcgcggaattccgtcgcaagatgcaggcgcgtcgccgcatgaagaaccgtatcgcactaacgctctcaatggcgacgatggcatttggcctgttctggctgatctggattttgatgtccaccatcacgcgcggcattgatggtatgtcgctggcgctgtttaccgaaatgacgccgccgccgaacacggcgggcggcgggctggcgaacgccctggcggggagtggattattgattctctgggctaccgtattgggtacgccgctggggattatggcgggtatttacctggccgagtatggccgtaaatcctggctggcggaaatcattcgctttattaacgacattctgctttccgcgccgtcaattgttgtggggctgtttgtttacaccatcgtggtggcgcagatgcagcacttctccggctgggcaggggtgattgcgctggcgctgttgcaggtgccgatcgttatccgtaccactgaaaacatgctcaagctggtaccggatagcctgcgtgaagccgcttatgcgctgggtacgccgaagtggaagatgatctccgcgattacgctgaaagcctctatctccgggattatgaccggtattctgctggctattgcgcgtatcgccggggaaacggcgccattgttgtttaccgcgctctcgaaccagttctggagcaccgacatgatgcagccgatcgccaacctgccggtgaccatttttaaattcgcgatgagcccgtttgccgaatggcaacaattagcctgggcgggcgtgctgattattaccctgtgcgtactgctgctgaatattctggcgcgtgttgttttcgcgaagaaaaaacacggttaaagacattgtaggcctgataagcgtagcgccatcaggcattattttacggcgtggcggatgcggcgctggatgaggaaaagagtgaaatgagtatggttgaaactgccccgagtaagattcaggttcgtgatttgaacttctactacggcaaattccatgccctgaagaacattaatctggatatcgcgaagaatcaggtaacggcatttatcgggccatccggctgcggtaaatcaacgctactgcgtaccttcaataaaatgtactcgctttatccggagcagcgcgcggaaggtgaaattctgctggatggcgacaatattctcaccaacacccaggatatcgcgctgctgcgcgcaaaagtggggatggtattccagaagccgacgccgttcccgatgtccatctatgacaatatcgcctttggcgtgcgtctgtttgagaagctgtctcgtgccgatatggacgagcgcgtgcagtgggcgttgaccaaagccgcattatggaacgaaaccaaagataaattgcaccagagcgggtactctctctccggtggtcagcagcagcgtctgtgcattgcgcgcggtatcgccattcgcccggaagtgttgctgctggatgagccatgttcagctctggacccgatctccaccgggcgtatcgaagagctgatcaccgagctgaaacaggattacaccgtggtgatcgtgacccataacatgcagcaggcggcacgttgttccgatcatacggcgtttatgtacctgggcgagttgattgagttcagcaacacggacgatctgttcaccaagcccgcgaagaaacaaacagaagattatatcaccggtcgttacggttaattcaggagtgcgtaatggacagtctgaaccttaataaacatatttccggccagttcaacgccgaactggaaagcatccgcactcaggtaatgaccatgggcggcatggtggagcagcagctttctgacgctattaccgccatgcacaaccaggacagcgagctggcgaagcgcgtggtagaaggcgaccatcaggttaatatgatggaagtcgccatcgatgaagcctgcgtgcgtattatcgccaagcgccagccgacggcgagtgacctgcgtctggtgatggcgattatcaaaaccatcgccgaactggagcgcattggcgacgtggcggataaaatctgccgtaccgcgctggagaaattctcccagcagcaccagccgctgttggtgagtctggagtcgctgggccgccacaccgtgcagatgctacacgacgtgctggatgcgttcgcgcgcatggatctcgacgaagcggtgcgtatctaccgtgaagacaagaaagttgaccaggagtacgaaggtatcgtgcgtcagctgatgacctacatgatggaagactcgcgcaccattcccagcgtgctgaccgcgttattctgcgctcgttctatcgagcgtatcggtgaccgttgccagaatatctgcgaatacatcttctacttcgtgaaggggcaggatttccgtcacgtcggcggcgatgagctggataagctgctggcggggaaagatccgaaagagtaaatctcattcttttgcccggtggcgctgcgcttaccgggcctacaggtacagatgctgtaggccggatgagcgttagcgccatccggcatttcagttaacgcgtaatcttccacccgcgcgctttccacaatcccggcaactgcgccaaatcggtaaatgtcgtcacgttagggtgatcgatcggcttgttatgcggatcggcgcagaaataaaatacttccattcccgccgcaattcctgactgcgcgcctgcgctggaatcatccaccagaatacacttctcaacattgaccttcatggcgttcgccgcatggagcatcagcgccggatcgggcttccagcgttgaatatcgtaaccgctaaacagcaaatcgggaaaatgatgcaacatgcccagtttacccagcgaatgctgcatcttactgaccggcccgttggataccacgcacatgggcgtcttaatgctctccagcagggtatttgtgcccgcgatcgcttccagttcggtatcgaacaggcgcgccacttccgcgcgatacaccggctccagctccgcctttgccagcgcaacgccatgctctttactgatggtatcgataatttcgtagagctttacgcctttaaagcgtctgaatacttccgtgagctcaagcgtaatgccgaactgccggaacatagtgacataggcgcgcgagcaaattacttcactgtcgaccagcgtgccgtcacagtcaaaaaacaccgcttcgatttgggacatgtcatttccattttaacaagtttaacgtttacgtaatgctgaatgaggggacgcaatcgttgccgtactaacaaattgagtgaaaaaaattaccacacaactgcgccaggtgtcgcattttggtataggataacggcgaattttccctcctttctccggaaattgataatgagtcaacaacacaccacccaggcttctggtcagggtatgctggaacgcgtgtttaaactgcgcgaacatggcacgacggcacgaaccgaagtgatcgccggttttaccactttcctgacgatggtttatatcgtttttgttaacccgcaaattctgggcgtagctggcatggacaccagcgccgtctttgtgaccacctgtctgattgcggcctttggcagtattctgatgggcctgttcgctaacctgccggtggcgctggcgcccgcgatggggctgaatgcgttctttgccttcgtggttgtgcaggcaatgggactgccgtggcaggtaggcatgggcgccattttctggggcgctgttggtcttttattgctgactatcttccgcgtgcgttactggatgattgccaacattccggtcagcctgcgcgtgggcatcaccagcggcatcggcctgtttatcggcatgatggggctgaaaaacgccggcgtgatcgtcgctaacccggaaacgctggtcagcatcggcaacctgacttcgcacagcgtgctgctgggggttctcggattctttattattgcgattctcgcttcgcgcaacattcatgcggcggtgctggtgtccatcatcgtcacgacgctgcttggctggataatgggcgatgtgcactacaacggcattgtctccgcgccgccaagcgtcaccagcgtggtagggcatgtcgatttggcaggctcgttcaatcttggcctggcgggggttattttctccttcatgctggtaaacctgtttgactcctccggtacgctgattggcgtgaccgataaagccggcctggcggatgagaaaggcaaattcccgcgcatgaagcaggcgctgtttgttgatagtatctcttccgtcactggcgcatttgtcggaacctcttctgtgaccgcttatattgaatcgtcttccggcgtttcggtgggcggtcgcaccggtttgacggcggtggtagtcggtattttgttcctgctggttatcttcctgtcgccgctggcgggcatggtgccgccttacgcggcggcgggcgcgttgatttacgtcggcgtgctgatgacctccagcctggcgcgggtaaactggcaggatttaaccgaatcggtcccggcgtttattacggcggtaatgatgccgtttagcttctcgatcaccgaaggtatcgcgctgggctttatctcttactgcgtgatgaaaatcggtaccggtcgcctgcgcgaccttagcccgtgcgtagtgattgtcgcgctgttattcgtgctgaagattgtgtttattgacgcacactgatgaaatgaaccctcgccccatcggggggagggtgtttaactaacttacgctttaacgcgctgaatatactcgccaaatgcggtcaactgaccggtcaaatgatctaacgttccctgatccaccacttctccagtctgcgggtcgactttattctgaatcacgccgcccataaattccggtttattcatcaccatcgcatcaaggaacaccagaatctggcgcagatgatactggcagcgcgcgccgccaatcgctcccattgagctggtctggataagaacgggcttacccgccagcggctgctcaggcagacgggatagccagtcgatggcatttttcaggccgccgggaacggaatagttatattccggcgtcacaatgacgacgccgtcggcgttgcgaatctgctccgccagcgcctctacgctggctggaaatccctcttcctgctggatatcggcgtcatacagcggaatatccccgattgaaggcagcggcgataccgtcattcctgccggcgcgactttaggcagcgtacgcgccaccatcccgttaaaggaacctttgcgtaaacttcccagcaatgtaaccacattcagcatttcagacatacgtgccccttttttcattatgaacgattaagcgtatacgatttggcggcggggagttgggcgaatcgcatcagacggccggttggctcattggcgcgcgtctggatatcgggcaggcttttccagcccagtttgccatcgaactcccacacttttaatttttctatcgctggcgtaacggttacggaccataccagcacatcttccgcatcgcacacggcttcaagctgcgtgacatgcgcgcacttcaggcgtccggcaacgggtaaaagttgcagctcccgcggatcgtcattcatgacatcgccggtgagttttaacacgctctggcgcaatgtaatgagttgcgctcgcgcttcgttgggatcgttttgattggctacccataagttttcattacgggagaaagggtggcgttcgagcgaatgcggatggtgaaagccgcgggaggtgcgctgtaattccatatccagcccgcactctccttcggtggtcaacgccacgccaaccatatttccggcgtaggagatagaaaaacctggcagatttttgtcacgaaacgcgggtttacctttcgcctgaataatgatttccggcagctcgctaattccgtacagcataaacatcagttcggcaagaaggcctctggaggcgagaaaacgcgttcgtcggtgagcaggcaggtttctggcttcaatatggcaagacgaagagagacgaattgaaaccaactgtccctccgtaagtatccctctggcaaagtgagtcgccatttttcgctccgtgattaatgggccgtgataatgacgagagtaacattaacgtaaattatggacaggttttacgcgctaaaaattcaatttcagaaggttctttaatcagacggtgacatttctggtaagagtaaggttaatttatcaacgcaggtggtcagataaggcgacggcagagcgtgttgatagcctgtcgtagccacacaatcttgggattatgactattacgtttgtgccataatagggtaaacggcaccatcagcttttcccgctgttgcgcatcaaaaggcagggggcgcgccactaacggtagctggtggagctgattgtagtgctggcaatagcgcggcgcggttgctatcagggtgtgacccggctgggcggccataaagagcgactgctcgaaccccggcaggcttaacgcgatatggcgtttgcgtcccatttcttgtaggacatcatccagcgcccaggtatcgctttgctcccagcaaatactgatatgcgggtagcgcagaaaagtgtccagatcccacgtttcgcgcagtgccggatgatcttcctgcagccagacccacggtaaatcgctaaacagtacctcaaagtcaatcgcgagcggcaacagactgatcaactctcgcgagcggggatggctttcgcgtccggtaaatccgatatcgactttcccgcgcgtaatcgcctccagcgagtcataatcccagttgcgaaccttaatggtagcctgcggatagcgctgataaatctgctgcgacagtgaattaaacataatcatcatcagcggcgactctgccgccaactcaaattttaaaccgcgcggcgtttgatgatgtggcttatcaagcagttgattccccatctgcatccagtccgccagactttgctccatactgaccatcagcggcgtcggcgccaggcccagcggcgtattgacgaacagcggatcgtcaaaccatgcccggagtttcgccagcgatttgctgaccgcagagggcgttacgttcatccgttttgcagctttagtgacgctgcgctcctgcatgagtaactgtaggcataacagcagattaagatcgagactggtaagggatttcttcatgctcggctacggacctgttgggcgcgacggagaagatcagcagaatactcactatgctacaaccaatcagaatcccgatcagcatattcatcgcgctgataccgagtattgccgccagccaaatccacagtgatgaaccgcaaacctgagcgatacccagcgtggaactggccactccggcgcgcagcgaaaacggccccagcgcctggctcatcgcgacgccaaaaccaaccgagaatccggcgcagataagcgtcaggccaaagagcgtgacggtattggtatgagcaaggcttaacgtcacgccagccgtcaaaaacagcccctgtgagacgagcattaaggttcgcggcttaaataacccaagcgcaaaaggggtagaaaaagagacgaccatgctgacgcctgcggtgagcgccatggtaatggcatagtcgccacggctaaatcccatcacctccatcagcagcactggagaggcattgacgaaggtcaggatcaccgacacgctaagggtggtgatcgctagtcgactaacgaaaaaacggttaaccagcgactcggcggcggacgacgatggtgataaatcgcgtggagccagccttgccgggcgcgtctcgcgcaggataaacagtgataacaggcccaccataatgcccatcgtggacatcgtatagaacagactttgccaggggaaacgaagcataatcaaatgccccatcaccggggcgagtaccggcacaatacaggtaatcccattcaataatgacagcactttcgcccggcgatgctcgtcgagcgtgtcgcgcagaatggcgaacgccaccacatagcagccgcctgctcctaccccctgaagaaaacgcccactcagaaatagcgagccttccgacgcccgtgaacaaagcagtgaggccatcataaagacgatcgcgccgacgatcgcgaccggcttgcggcctgactggtcggctatcttcccggcaaacagcatggccgtcgccattccggccaggtaaacggagaaggcgatatgcaactgcgcctcgctggcgttcagatcggcggctatacgcggtaaaccgaccagatacatatcaataccagcaggatagagtaaaaccagggcaaaactacacagtagaaaacgtttcatagcggcctcacgaaaagtgtggcgctaagaatacggggcgacgttgcgcgagacgagttgtcatttggacaacagtgatttccgcatgggaaatcattgctgccggatggcggcgtaaacaccttatccggcttacgggttttgtaggcccggtaagcatcgcgccaccgggcaacacaacgttatttaccgatacagaagctggagaaaatccgtcccagcaggtcgtcggaggtaaactcgccggtaatctcgcttaagctttgctgcgccaggcgcaactcttccgccagcagttcccccgcccatgcgcctaatagctgcgctttgccctgttcaagatggttagcggcttccgccagcgcctgcaggtgacggcggcgggccaggaagccgccttccatattggtatcaaaccccatgctctgcttgaggtggttacgcaacacgtcgacgccttcgccggtacgcgccgagaggcgaaccagtgagtgaccgtttacttcactaatacccagcgtttcgccggtgatatccgccttgttacgtaccacggtaatcggtagatttttgggcagacgggcgataaagtccggccagatgtcggcagggtcaacggcgtccgtcgtggtgccattcaccataaacagcactcgatcggcctgttcaatctcctgccaggcgcgttcgatgccgatacgctcaacttcgtcgttggcgtcgcgcagtccggcggtatcgatgatatgcagcggcatcccgtcgatgtggatgtgctcgcgcaacacgtcgcgcgtggtaccggcgatatcggtgacaatggccgcttcacggcctgccagcgcattcagcaggctggatttcccggcattcgggcgtccggcaatcactaccttcatcccttcgcgcagcaggctgccctggcgcgcttcggtgcgcacggcgtcaagatcggcgatgacgccattgagctgcgcttcgattttgccgtcagagagaaagtcgatctcctcatccggaaaatcaatagccgcttcgacgtagattcgcaggtgagtaagtgcttccacaaggtggttaacgcgggcggaaaatgccccctgtaacgagtttagcgccgaacgcgccgcctgttcggaactggcatcgatcaggtcggcaatggcttccgcctgggctaaatcgagcttatcgttgaggaacgctcgctcggagaactcgcccggtcgggcaattcgcacgcctggaagcgtcaggatacgttttaacagcaggtccagaatcaccggaccgccgtgcccttgtagctccagcacatcttcaccggtgaaggagttcgggccggggaaccacagcgcaataccctgatccagcgcgctgccgtcaacatctttaaacggcaggtagtcggcatagcgcggcttcggcagcttgcccagcacctcttgcgcaacgtcgcgcgccttcagaccggaaatacgcaggatacccacgccaccgcgtcccggtggggttgcctgggcgacgatagtgtcgttatggctcatggttagtctcaactttgttgcaataaaaaaaggcggtcatatgaccgccttttgattgtaggcctgataagcgttagcgccatcaggctgaccggcgcgccttgccggatggcggcttcgccttatccggcctacaccgaatcaggattttttcttctcgcggctatgcaggccacgcttctccagaccacggtaaatcagctgctgctgaatgatggtgaccaggttgttgacgatatagtacagcaccagacctgacgggaaccacaggaagaacactgtaaagatgaccggcataaaggtcatgatcttctgttgcatcgggtcggtcacggtggtcggcgacatcttctgaatgaagaacatcgttacgcccatcaggatcggcagaatgtagtacgggtcctgtgcagacaggtcatgaatccacagcgcgaacggcgcatgacgcagttcaatggaacccatcagcatgtagtacaacgccaggaagataggcatctggatgatcagcgggaagcagccgcccagcgggttaaccttctccgctttgtacagggccatcatctcctggctttggcgctgtttatcatcgccaagacgttcgcgcatcgcctgaattttcggctgcagcatacgcatcttcgccattgacgtgtactgcgctttggtcagcgggtacatgataccgcgaacgataaaggtaatgatgataatggagaagccccagttgcccacaaagctgtggatccacttcagcaacttgaacagcggctgagagatgaaccacaaccagccgtagtccacggtcaaatccaggtgcggtgcaacagccgccattttatcctgaatttccgggccgacccacagggtgctggtcatcgcgccagtctggcctggctgtaccagtaccggctgcgctttatagccgatagcgacaatgccgttacccagattggcggtgtagaaattgttggtgccgtcgttacgcggaatccatgcggtagcgaaatactgctgcaacattgccacccaaccgcctttggagctgacgttgaggttttcgttatcggcaatggtgtcgaatttgtatttctcatacttctcatccggcgtggagtacgctgcgccgcggaacgtatgcaacgcaaagttgctactgccggtgtcgcgatgaggaggcaggttgacggattgttttaactgaccaaaggtggagacttccagcggtttttcgccggtgttctgcacgctatagttcacgttaaccgcataatcgccacgcttaaagacaaacgttttggtaaacgtgttgcctgcggcgtcagtataagtcatcggaacctgcagttcgttctgaccgtcggccagtacaaacgcatctttctcgacgttgtacagcggacgcgggccgttcgccgggttatccgggccgtcgcggcctgtcaggccgctttgcgcctgatagataaactgcggggtggtttccagcagctggaacggttcgttggaacccagttctttcgggtaagccgggagcaaggcctgctcgacatcaccaccacgggtgttgatagtcaaatcaagcacatcggttttcaccgtaatcattttcccctggccactggctggtacgccctggtcggcggcgctacccgctgcggtggtcgttgtctgcatggtctgttgagtctgaggttgcggatttttatcctgctcccaggcttgccagatcatgaaagacacgaacagcaaagcgatgactaaaagattgcgttgcgaatccatcgttagtgttctctggtatcaaatggtccgggcgggacgggatcgtcaccaccagggtgtaaagggtggtattttaatacgcgtttcaccgtcaaccaactgccttttatcactccaaacctgcgcaatgcctcaattccgtagcttgagcacgttggcgtgaaacgacaatgcggcccaagcagcggactgatcaggcgttgatagacccgaataagggctatcaggacccgcgagtcaggcgacagtggcggcgccataatttttccaacgcttccgagagagcacggttatcgaggtcggcaaccccttttttcgccaccaccacgaaatccattgcaggaagttcatgctggcgcagacggaagctttcacgcgtcagacgtttaatccggttgcgttcatgcgcacgtcgaacatttttcttggcgacggtaagaccgatacggggatgccccagcgaattcaggcggccgaggatggtgatttgcggcgtgccagcccgttgaggttgctggaagacgaatgtgaaatgagcgggagttaacaaacgtaactccctgggaaatgcgagcttaaccactcaggggttagctttattacttggaaacggtcagacgagcgcggcctttagcacgacgacgtgccagaacctgacgaccatttttagtagccatacgagcacggaagccgtgagaacggttgcgcttcagtacagacggttgaaaagtgcgtttcatggcgatttctacctaaacttgaataaattcactgacttttgcgtatacccgaacaaactttgaacgacttacgccacagtgtgggtgattaaagaggccggattgtaataattgtacactccggagtcaattctctttccttactttcccgcgattttccacgcctttttgtgcggaaaataagcagcgttgacgccatatgacgggcattgcgcgacgggtggagaattatacggactgccaggtaaagcgcaaggatcgccctggatctttatgcgatcttttaggcgtctgctcacctttacatattaattttttcaatatgcgcgcgaaagcgtacaggagttcccctggatcgattacacttatcctttcctggaaagccctgtggataaatcgggaagaatctgtgagaaacagaagatctcttgctcagtttaggctatgatccgcggtcctgatcgtttcaaacgatcctggtcaggcatgaacacgaaatctttcagactgcgtgaagtcgcgatcgtttgaaagatccgtgaaaaccgcagacagcggttagtgcgtcacccttcatgcagggtcttatcgacgtgcgccaacaatcattaatgtatcagcctttgtcatttatcgacttttgttcgagtggagtccgccgtgtcactttcgctttggcagcagtgtcttgcccgattgcaggatgagttaccagccacagaattcagtatgtggatacgcccgttgcaggcggaactgagcgataacacgctggctttgtatgcgccaaaccgttttgtgctcgattgggtaagagataagtacctcaacaatatcaatggattactcaacacattctgcggcgcggatgccccacaactgcgttttgaagtgggaacaaagcccgttacgcaaacgctaaaaacgcctgtgcataacgttgtcgcgcctacgcagacaacgacggcgcaaccgcagcgcgtagcgcccgcggcccgttcgggctgggataacgtaccagcgccggcggagccgacctaccgctccaacgtcaatgttaagcatacatttgataacttcgtcgaaggtaaatccaaccaactggcgcgcgcggcggcacgtcaggtggcggataatcctggcggcgcctataacccgttattcctctatggcggcaccggtctgggtaaaactcacctgctgcacgcggtgggtaacggcattatggcgcgcaaacccaacgcgaaagtcgtgtatatgcactccgagcgctttgtgcaggacatggtaaaagccctgcaaaataacgccatcgaagagtttaaacgctactaccgctccgttgacgcattgctgatcgacgatattcaattcttcgccaataaagaacgatcccaggaagagtttttccacacctttaacgctctgctggaaggcaatcagcagatcattttgacgtcggatcgctatccgaaagagatcaacggcgttgaggatcgtctcaagtcccgctttggttgggggctgacagtggcgatcgaaccaccagagctggaaacccgcgtggcgatcctgatgaaaaaagcggacgaaaatgatattcgtctgccaggcgaagtagcgttctttatcgccaagcgtctacgctctaacgtacgtgaactggaaggcgcgctgaaccgggtgatcgccaatgccaactttaccggccgggcgattactatcgactttgtgcgcgaagcgctgcgcgatttactggcgttgcaggaaaaactggtcaccatcgacaatattcagaagacggtggccgagtattacaaaatcaaaattgcggatctgctttctaagcgtcgatctcgctcggtagcacgtccgcgccagatggctatggcgctggcaaaagagctcaccaaccacagtctgccggaaatcggcgatgcgtttggcgggcgcgaccacactaccgtacttcatgcctgtcgtaaaattgagcaactgcgtgaagaaagccacgatatcaaagaagatttttcgaatttaatcagaacattgtcgtcgtgatcctatgaaatttaccgttgaacgtgaacatttattaaaaccgcttcagcaggtcagcggcccgctgggcggtcgtcctacgctgccgattctcggtaacctgctcctccaggtagcggacggtacgctttctctgaccggcaccgatcttgaaatggagatggtcgcgcgcgttacgctttctcagccgcatgagccaggcgccactaccgtgccggcgcggaaattctttgatatctgccgcggcctgccggagggcgcggagattgccgttcagttggaaggcgatcggatgctggtgcgttctggccgtagccgcttctcgctgtctacgctgcctgccgccgatttcccgaatcttgacgactggcaaagcgaagttgaatttacgctgccgcaggccacgatgaagcgcctgattgaagcgacccagttttcgatggcccatcaggatgtgcgctactacttaaacggtatgctgtttgaaacggaaggtagcgaactgcgcactgttgcgaccgacggccaccgtctggcggtgtgctcaatgccgctggaggcgtctttacctagccactcggtgattgtgccgcgtaaaggcgtgattgaactgatgcgtatgctcgacggtggcgaaaacccgctgcgcgtgcagatcggcagtaataatatccgcgcgcacgtcggcgactttatctttacctcgaagctggtggatggtcgtttcccggattaccgtcgcgtattgccgaagaatccggataaacatctggaagcgggctgcgatatcctcaagcaggcgtttgcccgcgcagcaatcctctcgaatgagaaattccgcggcgtgcgtctgtacgtcagtgagaatcagctcaaaatcaccgccaataacccggaacaggaagaagcggaagagattctggacgtgagctatggcgggacggagatggaaatcggctttaacgtcagttacgtgctggacgtgctcaatgcgctgaagtgcgaaaccgtgcgcattatgctgacggattccgtatccagcgtacagattgaggatgcggcgtcacagtcggctgcctatgttgttatgccaatgcgcttgtaaagaatatcgggctatcttacttgttattctggctccgggcagtgctcgcacaaaatacgaagtattttggacgtcttatggacggcccgaagggcgagcgcagcgagcaatcctcacgtactccagtacgctccggttgctgtgcgctggccgtaaccagactaactgcgccgataacgccctggttatgagttgatatgtcgctatccagactgctaatcaaagacttccgcaacatagaaaatgcggatctcgctttatcccccggctttaatttcctggttggcgccaacggtagcggcaaaaccagcgtgctggaagctatttatacgcttggccacggtcgggcgtttcgcagtttgcagcctggccgcgtgattcgtcatgagcaggaagcgtttgttcttcacgggcgcctgcagggcgaagagcgtgagacgtcgattggcttaaccaaagataagcagggcgacagcaaagtccgtatcgacggtaccgacggtcacaagatcgcggagctggcgcatttaatgccgatgcagttgattacgccggaggggtttactttactcaacggcggccccaaatacagaagagcgttccttgactggggatgctttcacaacgaagccggattcttcaccgcttggagcaacctgaaacgattgctgaaacagcgtaacgccgcgctgcgctaggtgagccgttatgagcaattgcgcccgtgggataaagagctgattccgttggcggaacaaattagtacctggcgggcggagtacagtagcgctatcgcacaggacatggcggatacctgtcagcagtttttacctgaattttccctgacgttctctttccagcgcggctgggagaaagagacagactatgcggacgtgctggagcgaagctttgagcgtgaccgtatgttgacctacaccgcgcacgggccgcataaagcggactttcgcattcgcgctgacggcgcgccggtggaagataccctgtcgcgcggtcagctaaagttgttgatgtgcgccttacgtctggcgcagggcgagttccttacccgcgaaagcgggcggcgctgcctgtacctgatagatgattttgcctctgaacttgacgatgcgcgtcgcggactgctggccagccgcttaaaagccacgcaatcgcaggtctttgtcagcgcaattagcgctgaacacgttatagacatgtcggatgaaaattcgaagatgtttaccgtggaaaagggtaaaataacggattaacccaagattaaatgagcgagaaacgttgatgtcgaattcttatgactcctccagtatcaaagtcctgaaagggctggatgcggtgcgtaagcgcccgggtatgtatatcggcgacacggatgacggcaccggtctgcaccacatggtattcgaggtggtagataacgctatcgacgaagcgctcgcgggtcactgtaaagatatcgtcgtgactattcacgccgataactccgtgtccgtaacggatgatggccgtggcattccgaccgggattcatccggaagaaggcgtctcggcggcggaagtgatcatgaccgttctgcacgcgggcggtaaatttgacgataactcctataaagtctccggtggtctgcacggggtgggcgtctcggtagtcaacgctctgtcgcaaaaactggagctggttatccagcgagatggcaaaattcaccgtcagatctacgagcacggcgtgccgcaggcacccctggccgtcactggcgataccgataaaaccggcacgatggtacgtttctggccgagccacgaaaccttcactaacgtcactgaatttgaatatgagatcctggcgaaacgcctgcgtgaactgtcattcctgaactcaggcgtttccatccgcctgcgcgacaagcgcgatggcaaagaagatcatttccactacgaaggcggcatcaaggcgtttgttgaatatctcaacaagaataaaacgccgatccacccgaatatcttctatttctccaccgaaaaagacggtatcggcgtggaagtagcgctgcagtggaacgatggtttccaggaaaacatctactgctttaccaacaacattccgcagcgcgacggcggtactcacctggcaggcttccgtgcggcgatgacccgcacgctgaacgcctacatggacaaagaaggctacagcaaaaaagccaaagtcagcgccaccggcgacgatgcccgtgaaggtctgattgcggtggtttccgtaaaagtgccggacccgaaattctcctcacagaccaaagataagctggtctcttccgaggtgaaatcggcggtagaacagcagatgaacgaactgctgagcgaatacctgctggaaaacccatctgacgcgaaaatcgtcgtcggcaaaattatcgacgccgcgcgtgcgcgtgaagcggcgcgtcgcgcccgtgaaatgacccgtcgtaaaggcgcgctggatttagccggtttgccgggcaaactggcggattgtcaggaacgcgacccggcgctgtccgaactgtacctggtggaaggggactccgcgggcggctctgcgaagcaggggcgtaaccgcaagaaccaggcgattctgccgctgaaaggtaaaatccttaacgtcgagaaagcgcgcttcgacaagatgctttcctcccaggaagtggcgacgctgatcaccgcgctgggctgcggtatcggtcgcgacgagtacaacccggacaagctgcgctatcacagcatcatcatcatgaccgatgcggacgtcgacggctcgcacatccgtacgctgctgttgaccttcttctatcgtcagatgccggaaatcgtcgagcgcggccacgtttacattgcccagccgccgctgtacaaagtgaagaaaggcaagcaggaacagtacatcaaagacgacgaagcgatggatcagtaccagatttccatcgcgcttgacggtgcgactctgcacgcgaacgctcatgcgccagcgctatccggcgaagcgttagaaaaactggtctctgaatataacgccacgcagaaaatgattggtcgtatggagcgtcgcttcccgaaagcgctgctcaaagagctggtgtatcagccaactctgaccgaagccgatctttctgatgagcagactgtaacgcgttgggtgaatgcgctgattaccgagctgaatgagaaagagcagcacggcagtcagtggaagttcgatgttcatactaatacggaacagaatctgttcgagccgatcgttcgcgtgcgtacgcatggcgtggataccgattatccgttggatcacgagtttgtgaccggcgcggaatatcgtcgtatctgcacgctgggcgagaagctgcgcggtctgattgaagaggacgcgttcatcgaacgcggcgagcgtcgccagccggtaaccagcttcgagcaggcgctggagtggctggtgaaagaatcacgtcgcggtctggctatccagcgttataaaggtctgggtgaaatgaacccggatcagctgtgggaaaccaccatggacccggaaagccgccgtatgctgcgcgtgaccgtcaaagatgcaattgctgccgaccagctgttcactacgctgatgggtgatgccgttgagccgcgtcgtgcctttatcgaggagaacgccctgaaagcggcgaacatcgatatttaacctgccttaatccccggcccgccgctggctggccagggcatcatgatgttcatccatatatctgaatagaaactctttaaagcgctgcgtggcgggcgtttgcgcgcgccacgcatggaaataaaggttcatattgcgccgcagcggaggcgtgagcgaacaggtcgctaattgatagcttttggcgtaatggcgggaaaaggtttcggcgatcaccacgccttcacactgcgccgccagcgacatggcggtcgccatatgttccaccgtcattttgggcttaatgcgcacgccagcggtcgcggagatcatcggaacggattcgttgccaacggcgatcagctcttcgctctgaatctcttcccagcgcaccgtttttttatgcagccgatagtccggatggcagtacagggcgatttccgttgtgaacagcgtttgtttgtcgatttccggttccagcggccgctccgggccgataccaaaatcggcttctcccaacataatgcttttttgtaattgcgacatgggcttatcaataagctgtacgtgggtatgcggatgctgccgcttaaaggcatggatgatttgcggcagaaaagcacaggcgatcagcggcgcgccgaccacccgcaccagggattttttgatctctttcaggtcgcgggcataattttcggcccgttgaaactcttcaacaacccgcatggcggcgggtaaaaacttttcgccgtcgggcgatagcttcaccacgcgcgaagtgcggtcgaaaagggaaacctccatctggctttccatttcgttgattaaaccgctaacagctccctgcgtgatgcacagatatttgctggcggcggtaaaactacgcaaatccgcgacggccagaaacgcgcgaaattgccggatagttaaattcatttgccacctgtgttacccctttactgagaggattttatctcaggctggataaggtcgcgttgatacgactcgcaaatacagggtgtctgcctgcggcgcaggcagacagttggcttattttacggtgatggttggtgattttttcatggtttcttcggtcagttcctggccgatgccgggaagctccgagacttcgtacatgccgttcttcggcaggtagttgtatttacaggtctgtgtattcggctccagcagcgcataccggtgcagttcgtggatgacgaagttagggattgcggtttccatatgcagcgccactgctgtggaaatcggcccgccgcaaacgtggatttgcaccgttttgtcataaacatgcgccatatcgcagattttcttcacttcggtgatgccgccgcaggtacaaatatcgggctggatcacgctcaggctgccgttttccaggaaaggacggtatccccagcgccagtaaatgcgttcgccagccgccagtggaatattaattttatcagccacttgtttcatttgtccggggtttaacggcatgaccggttcctcgtagtagaagatgcccagctcttctatcatgcggccaaactgaatcgccgaggtggtatccgtaaaggcatgcatttcggcgatgatatccacgtccgggccgactgcatcgcgaatggcggccatacggtcgtagcccagacgcaggattttatcggtgagaggcccgttgaggttttgctggttccagttgccgtggcgatccattgcgacggtatccacttttatcgcgtcatagccttcgctgacggcggtcagcgccgcctgtgcatactgctccggctcggtcagcatatctttatcgctgccgtccccccaaccaaactgtaactgactggcgtaggttctgattttctcgcggcttttgccgccaagcattttatacagcggcacgccccacgctttgcctttgatatcccacagcgcgatatcgataccgctcattgctgcggaaaagatgccgccgccgccttgtccccagaacgtctttttgagcatcttttcccagatggcttcgttattcatcgggtccatgccgatgataatggcggctaaatcttttgccatgccgatgcctgcggaggcgccgacgccgtaggccaacccgacttcgccaaaaccggaaatgccctcgtcggtattaatttttaccaccaccggacgccatttgctggtggcggacgcaaaatcattagcaacatcaataatatcaatgctggtaattttcatcatttactccttgtgattaatattttttaatcgttaaaacgaatgcagataccacggcgatagcgctgatgaaaaccagacataataagccgccggtataggttcctgtaatagagataaataaaccgataaatactggtgataatgatgacaggccgttcgcgacgccgttcattacgccgctggcggcggaaatagatttcccggacaccatcccttgtaataatgtccacgcaacaggcgtacccatcgtgcaaaaagcgacggcgaaggagagtagtaccgctgacatatatttgtgttcggttattgtgccgaaatagatactgataccggcgaaaaacattaacaccattaatatgggggcgctgcgtcctattttatcgacgaagacgcccgcggcggctttggaaaatatcgacaagacaaacggcagcgacgctagccagcccatttctgcccagctaaatcctctggctgatttaagataggttggcagccaggtaatcatcccccagtacaggcattgcagacacaggtaccacagcaccagcaaccagtagcaatagttggtaatcaccggttttacccgcaacataaaactttcgctgctgcttgcgctttccgtttcctgcccggctttgatataagccagttcctgctcgctgatacttttatgttgttctggtttatcagcaacatatcgccaaagtagccagagtgggattaacccgagagcggcgcataaaaagaagttggaacgccagccgtgggtgcctatccaccaggtgaaaaaaggcatcgcaatggcgggcgcgaccgactggccgacgatccacgctgcgtttgcccggccacgctcctgcttcggaaaccagtttttaataaatacgctttgcagcggataataaaaaccctctccgatacccagtaatatgcggcaaataataattaatgcaaacgatgtcgcaactccgccaataattaaggcgatggtccagattaggatacaaagcatcatcgcttttctcggaccaaggtagtcgccaagtggtgataatacaacattagcgataccataagcggcaagaaaaacggtcatcatcatgtcaatttgcaatggcatgccttcaatacccatataggctaagaagggttcgtttgcggctaataccgaaacattaacgcggtcgagataggcaatgaatattccaataaacagacaggcaacgattaaaaatcttttcctgccaggcggggcggtaagggccatcgacatttggcgatctcctttaattaaattaacatcatttttgtttatttttacaatagggtgattcatgaccagggtaacaatatcgatgagattagaaaaacggtattttctgtttgattaatgaggttatctaataaatgtgagtattcactgcacaaaactcgccttctgtactgagcaaaagaggaaggtttgtcttattctttagccccgtttatccctgactcttttgctgttttttgagcggaatcgcgttagcatgagtcaggactcatttaatgcggggatttcatggctattaaactcattgctatcgacatggatggcacccttttgctgcccgatcacaccatttctccggcggttaaaaacgccattgccgctgcgcgtgaaaaaggggtaaacgtggtgctgaccacaggccgtccgtatgcgggtgtgcacagctatctgaaagaacttcatatggaacaacccggcgactactgcatcacctacaacggggcgctggtgcagaaagcaggggatggcagtacggtagcgcaaacagcgctcagctatgatgactaccgttatctggaaaaactatcccgtgaggtgggttctcacttccacgcattagatcgaaatacgctttataccgctaaccgcgatatcagctactacacggtgcatgagtcgtatgtggcgaccattccgctggtattttgtgaagcggagaagatggacccgaacactcagttcctgaaagttatgatgatcgatgagcctgccgttctcgaccgagcgattgcgcgtataccggcagaggtgaaggaaaagtataccgtgctgaaaagtgcgccgtacttccttgaaatcctcgataaacgggttaataaaggcaccggcgtaaaatcactggccgaggcgctgggtattaagccagaggaggtgatggcgattggcgatcaggaaaacgacattgcgatgatcgaatacgccggtatgggcgtggcaatggacaacgccattccgtcggtcaaagaggtggctaactttgtgactaaatcgaaccttgaagatggtgttgcctgggcgattgaacaacatgttctgtcctgattcactccggcccgatcgccgtcgggccgatagttccactcatgaagctaatgtgttgcaacaaagacgttgtagaaaatagttttttatttcaaaagattaattcgcacagaaatcccgcccaccaggcgacgattactatattctccctcctcctttcgatccggcggcgcttctcgccagaataaacgcttcatcattatgaaaaaacgctcccttttgctgttggcgctgcccgctatggctttttctacctgggcggctaccagccccccggcgaacctgtcgccggtttatagctatcaggatgacgtcccatctgctgccacaccgccagtcgcgacaacgccggtggcaaagcctgccagtacatcagtgttgccttttctgggtgatgaagcccgaaagcgtggctatgagcttcccgagccatttggcctcaatattaactacatgaatattgggcagaatattaacgttgatagcatcaactttaatggcctggctttaggtcccaacgggggaattccattagataacgcgtttaaaattaacgtcggtcatacccgtgaaaagagcaagaccgaaacggtcaagctggatgtctggctgctgccatttatgaatgtgtacggcctggtgggctataccgatggtcattccgtttcgcaaattggtgttgggttgatgacgaaaaatggccacgtttttcatcccgccgatctgcaaaacctcaagtttaaactcgactttaaaggcactacctatggtatcggcaccacgctggtcggcggcgtaggtaactggtttaccgctgttgatgctaactacacccagacacagttcgatattcttgatggcagcatcgacgcctttaccgtctcacctcgcgttggttaccgttttaccaccccgggtatagataagatgcatctgccgtcgggcaagctaaacgtctgggtcggcagcatgtatcaggatgtgcagcaggagtttaaaggcagcctcgacgacctgaccatgccatcagcgacgctacaaaggctggtgagtatggctaactataacaataacggccgctttgacgtcaaacagcatctgcaatcaccgtggaacatgctgctgggcgctcagtatgaaataacccgccatttcaacgttaccaccgagtttggctttgccgagcgcaacagcttctttgtggccggtgagtatcgcttttgaaccgctgccattgccgacagttgctttgcgtcgccggtgtgctgtccggcgtggcgcaggcggcgctgcccagccgcagtcaggtggacggctggctacaacaaatgggggatagcgatacttacgatgccgccaaaggcgtcaactggggagtaatgcccgggccattttatacccctgaactggggctgggcatcggcaccgccattgtcggtatgtatcgccccgatcctgccgataaggttagccagatatccacgctgtcgctgagcggctattttagctccacgggcgctttcggcgtaagcctgcaaaattacgcctttttcgcgcaagatcgctggcgtttcttccttactggcgcattgagcgacacgcccacttactattgggggcagggttttgccgccggtgataaagacagccataagcaggcctataccgcgcaggtgctggatctgcaacccatgctgtatcgtcggctggtcaacaatatctatcttggcgttggctggacgctggatgtacagcacgccgcgcaaatcaatgaggacgatccgcccagaattcaacatacagcgcagggcggttcttcactgagtaacggcggtagcgttgagattagttgggacgaccgtgattttatgcctaacccacgcaaaggacagtatgccacccttcgctatacccacttcgcgccagacatcggtagcgatacgcggttcgatgaataccagttgcactacagtcaataccacgccgttgatgataaagacgtgctggcctgggaagctgacggtgcctttacccagggctacgtgccatggaatatgctgccgctgctgggcagtaaccatcgtatgcgcggctattatgaagggcgctatcgcgataaaaacgccgtcagtggccaactggaatatcgccataagttgagctggcggcatggcgttgtcggttgggtgggagcgggcaccatgggatcgtctttgcaccatctggatgacgggcgatggctgccttctgcgggcgtgggctatcgctttgagttcaagccgcgcgtcaacgtgcggctggattacggcgtgggcaaaggcagcagcggtttttattttcaggtaggagaggcattttgaggactatcgttcgggttatctttctggcgctgctgtttctggcggggagcgcccgcgccgccttaccactgacgctctatctgtccacgctcccaatgcctgctgccagtgaagcctggccaacgatgccgccacagccgctgccaaaggggttgcgtccgtgttgcgcttttggttacgacctgcatgccgagctgctgggactgccggttccgttttatcagttaaataacgtcgtgacggtagactcgctggggcatcatcagtacaacgaccatctgtactcgggcgtggcaaacctgatcggccttagcggtgagaataacggtattgtgtataccttgcgtggcggattcatcgacaccgcacatgtgcgggataccgctgatatgacagtgtatatcttcagccaactactaccaaagctggggcaggcttttacgctgaatctgggcgaggagctggccgaacggcgtctggtctttactgcttttacccctccggtcgatgcacgcgagcgttacacgctggccgcctggctgtcggcgcatctggcgttccaggtggcggagtggcacgaaatcgcccaatggtacggtttcgagtccgttcgcggattttctgagggagtatcggccttttcgccggaagatctctattctaacctcgcgggtgcccgtctggcggcgtctttaattgtcgacggccagacgaaaacgcaagagatgtacaacacggcgatggaaactgcgctgcggcaagcgctgacgcagctggcagcgcagccggcgcagatcacccgttttcagtttgatatgcttgatggtcgttggtggaacagccagcggcgggtaccggaaaaatatctggtgctgcatcgtaattatcagatgggcgatgaccgcctgccgaccgcggttcctggcgagataacgtcgctattgccgctgagcttgccccatcgctggcgcggtatccagcttagcacgctggcgcagctacaattgtggcccagcgaggatatggcgcagctaccgcctcccgcgcactattacagcgaaaaagattttgccgccctggcggagcaggcacggctacaggacgaaaaaacacagaatcattaaacaggcggtagccgtaggctatttccctcttataccctcggcgtactgttttatgtcctgataactggcgatgtgaaacgcgtcgtttggcgagccggaaatcatcatggcgaaggatgaccggctatccatgcgtcgagcgccgtcactccctgcgtcacgatagttttaatatctatatcgctaagcggttgcaattccagctcccgacaggcttcggttgcctgcgtcatccccaggctggcgcagccgctttttaatttatgcgccagccgcttaatgttaacgtcgtcattcatggcgcgcgccgcctcgatctcctcgactaaaggcagcgcgctgtctttgaataaggcgacccattgccggagcttttccgggccgacagacgccatatcgccggcaagctgatgttcattcaacatcacccgcgcgttgtgagatttgccctgtaaatagtgcgctatcatgcggtaaagctcctcgcggggaacgggcttttgaataatcccgcagaaaagaccggcggtacgctgacgaagattatcgtctatcacatgcgcgctaaaaccaatgcgtttcatggcgggatacaggctcatcaactgctgcgccagggttaagccgtcataatccggtaaatcaaaatccaccagcgccacatcaaagggctcgccttcggctaaacagcgtagcgcgtcattcgcgctttcagctactgagaccttcacccctttacccgtgagcatttcagcggtaatacgctgcgtcagcatattatcttcaatcagcaacaggcgtagtccgttaagatttaccggttccctgaacgcacttttgcttgcaggtttggggtggcgaaccggcagttgtaagcgaaaacaactgccaacatgaagcgtactggtgacggttagcgtcccgcccatcgcctctgccaggctggcgctgatagccagccccaggcccgtcccgccccggcatcctgtcgcctgcacaaacggtttgaaaatagccgtcagcttcgcttcagggataccgcatccggtatcttcaacctcaataaaccagctctgatcgtcgcaaaacgtgcgcagcactatgctgccgcgatcggtaaatttcgccgcattacttaaaagattaatcacaatttgacgtatccggcgcggatcgccttgtagcgtggaagggagttgctcgctaaagtcggtgatgagcgccacctgcacgcggctgtgcattaaatgcagcgcgctattcaacaattgtcgcggttcaaacggttcctcgctaatggaaacgttggtgccgcctacttcaatcgccgagtaatcaagaatatcgttaagaatcgccagtagcgattcgcctgaatcattaatggcctgtaaatcgtcgcggtagtttgccatgagcggtttatcggccagcaattgtaccgtaccgagaatgccgtaaagcggcgtgcgaatttcatggctcatggcggcaaggaacgtcgatttcgcctcgttggccttttccgcttcggcgcgcgcctgccggtgttccagcaccagcgcatgaagctccgccgtttgcgatcgcacctgttccgccaaatcctcacgatggcggttcaatttgcgcacgttggcgcgaaacgcttccatcagacggctgatggtatccagttcgctgacgccagccgcctccggaaacggcgagtcaatatcgccctccagtagccgctgtaaggcctgcgtttgttgcgccagcgggcgggatacggaacggtaaaccactcgccaaagaataaaacttaatgagcacagcgccaggatacctaagatcactaaccctatttgcccacgctgactggtgtgtgtaagacgcgctaacccagcctcgtttcgtttttcgatggcgttcaccaactgcgacacttccgtactgaagcgggtaaactgaaagaggttattggccataagcgtttgaagctggtcgcggatggcgttttccttacgaaacagggtaaccagtgtcgtgtactggtttattttccccagcgcgtcggcgatttgggcgcgaacggtaggatcttctatacgctgctggcggcgggataaaattttaaccaactgattaagtttttcatcggtttccttggcatcgctcagcccttgcgcgtcttttaaggtcacaatgagctgcttaaaccgcagggcattgacccgcaactcattcatctgattcacatactcaaggtcgatatcaatcagtcggtcaagcgcgcgttcagcctgatcccctttaccgctttcgataagatcgtaaataccggcctgggtggcgcccgcagatgtcgctgcattattggcttgaccgtgagcctgggcggcaatgctttccgccgcctccgcaatctggcggcttaactgctgttgctgtgcgcgcagcgtgagaatttcaccgaccagcgttccctgctgcccaagcgtttgcgcaatctctttttcttgccgggcgatggccgaggtattaaacccctgctcgcttaatgcctgcaaaagatggttaattttaaggctttgcgctttcagcatcttcccctgcgccagccaaacgccctcgctgtcggcattggtcagattttgcgcggaaaagagctcgtaagcgctggcttcgcttaactgcctggccatattcatcgtggggagcagcgcttgcgtattggtttgctccacctgactaatgacgcgcaggcttatccagccgatcacggtgctgagcagggtgagtgccgccatcagagcgaaggccagccataatctgtgggtcagtgaaggcgttgacatttatgcgccgcgggtgaaatgggttgagttgccgccggaaaaaccattaggataaaaccttgttgctggtggggctatcatgcgcacgcttatttcgttcttttttttgataatcatcgtctcgaatgtagaaacggcgtcagccgaaaccgggttgctacactggacgcgcgccgatcgggcgattccctggcggcaaacgtcagtcaatgcgagtaaaccctggaaactgtgcgcattataccccagcctgaaagattcttactggttgtccgtcaactacgggatgcaaaaagcggccaaattgtatggcgttgatttaaaagtgctggaagcgaatggctatcggcaactggcgacgcaacaacagcaaatgacgcagtgccgggagtggggcgccgacgctattctgcttggcagcagtaccgatcgtttcccggagctggaacgatatgccggtaatgtgccggttattgaactggtgaacatgattcacgatgccagcgtcgcaacccgcattggtctgccgtggtttcagatgggttatctgccgggacgtttcctggtgcagtggagcaaaggaaaaacgcttaacgttttactcttcccggggccggaagaagccggcggcagtcaggagatggtggcgggttttcgtcaggcaattaaaggcagcgccatcaacattgtggatatcgcctggggcgataacgacattgaagtgcagcgaaacttactccaggaaatgctggaacgccatccggacgccaatgtggtcgccgggtcggcgatagcggcggaggcggcgatgggcgaagggcgaaatttgacgactccgctcacgatcgtctcattttatctgacgcatcaagtttatcgcggtttaaaacgcggccatatcctgatggcgctcagcgatcagatggcctggcagggagaattagcgataacgcagtcgattaaggtcttacaggggcaaccggtgcctgaaaatatcagcccgccggtacttattttgacgcataacaacgccgacagcgcgcgcgttcgccgttcgctatcgcctccgggatttcggcccgtctatctgtatcaatacacctccgaggctaaaaagtagccttcgccatgctgtgtgaccagcagttccggcgtaattttatgacgtaagtggcgaaccaggacatcaatcgtgcggagatccggggtctctacgcggcgggcggaaagcattcgcagcagacgttcgcgatgcagcactttgcctgggttggtcacaaaggccagcagcagctcgtactccgcgcgcgtaagcttaatggcttcaccgttgtgctccagcgtgtgattcatcacgttcaggcagtagccggaaaacatatagcagttttcactggcattttgcggcgtggggcgggccagatcgatacgccacaaaagatttttcacccgcactaccagctcgcgcagttccagcggcttggtgacgtagtcgtccgcgcccatctccagcccgacgatgcggtcgatttggtcgcaacgccccgtcaccagaataatgcccaccgtggagcgttcgcgtagcgccctggtcagcatcaacccgttttcatcggggaggttgatatccagcaggatcagcgaaacgtgctcatgctccatgatgtcacgcgcaggcccgcgccgctgtcggtcaccgaaacgcgatacccctcctgctcaaaataggcctgtaacctggcctgagtaacaggttcatcctcaacaataacaatgtgatgtgacatcctgcgcgcggtctctttctgttcatatctgttcatatattgccgtatcccgttcatcctgaccagtgacgctgttcatatttgcggaataagatctgcgcattaaaccatataattacaggggctattatgcgaaaactctggagagcgttactcaggccaagcacccgttggtcgatactggcgctggtcattgtcgggattgtgatcggcgttgcgctgatcgtgttacctcacgtcggtatcaaactgaccagtacgacagagttttgcgtcagctgccatagtgtgcagccggtgtatcaggaatataaacagtccgtacatttccagaacgcttccggcgtacgcgcggaatgccacgattgccatatcccccccgatattccaggcatggtgaaacgtaagctggaagccagcaacgatctttaccagacatttatcgcccactcgattgataccccggaaaaatttgaagctaaacgcgccgagcttgccgagcgagaatgggcgcgcatgaaagagaataactccgcgacctgtcgttcctgccataactacgatgcgatggatcacgcgaaacagaacccggaagcggcgcggcaaatgaaaatcgccgcgaaagaaaatcaatcctgcatcgactgccataaagggattgcccaccagctaccggatatgagcagcggtttccgcaaacagtttgatgaactgcgcgccagcgccagtacgcataatgacggcgatacgctctattcgctggatatcaagccgatttacgccgctaaaggcgataaagaaccggcaggttcgctgttgcctgcttctgaagtgaaagtccttaaacgggacggtgactggctgcaagtgcaaatcgaaggctggacggagacggacggtcgccagcgcgtgctgacgcagttgcccggtaaacgtatttttgtcgcctcgattcgcggcgatgtgcaacagcatgtgaaaacgctggaagagaccaccgtcgcggcgaccaatactcagtggagcaaattacaggcaaccgcgtggatgcaaaaaggtgacatggtaaatgacattaaaccgatttgggcctatgccgactccctctataacggcacctgtaatcagtgtcacggtgcgccggacaaagcgcactttgacgctaacggctggatcggcacgctcaacggcatgatcggtttcaccagtctggataagcgtgatgaacgtaccttgttgaaatatctccagatgaatgcgtctgataccaccaacacgccgcacagcgataagggagaacacaatgaaaaataaggactcgttacacgtctctcgtcgacgttttctggcgcagcttggcggcttgacggtggcaggaatgctggggccgtcactactgacgccccgtagcgcccgcgcagcggatgccgttgcgccaggcgccgcgacgaaagagggtatccttaccggttctcactggggggcgattcgcgccacggtggttgacggtcgatttgtggcggcaaaaccgtttgaacaggataaatacccgtccaaaatgatcgccggtctgcccgatcacgtccacaacgcggcgcgtattcgctatccgatggtgcgcgtcgactggatgcgcaaaggtcatcaaagcgacacctcgcagcgcggcgataatcgttttgtgcgcgtctcctgggatgaagcgctggatctgttctatcaggaactggagcgggtgcaaaaaacctacgggccgagcgcgttactgacggcgagcggttggcaatctaccggcatgttccataacgcctccgggatgctggcgcgcgcgattgcgctacatggcaatagcgtcagcacgggaggggactattcgaccggcgcggcgcaggtgattctgccgcgtgtggtgggttcaatggaagtgtacgagcagcaaacgtcatggcctctggttttacagaacagtaaaacgattgtgctatggggttctgatatggtgaaaaaccagcaggcaaactggtggtgcccggatcacgatgtctatcagtactatgaacaattaaaagagaaggttgccagcggcgctatctcggtcatcagcatcgacccggtcgtcacctccacgcacgattatctggggcgcgataaggtcaaacatatcgccattaacccgcagacggatgtcccgttacaactggcgctggcgcataccctgtacagcgagaaactgtacgataaaaatttcctcgataactactgcgtcggttttgaccagttcctcccctatttgctgggcgagaaagatggacagcccaaagatgccgcctgggcggaaaaactgtgcggtattgacgccgacaccatccgcgcgttggcgcggcagatggcgggcgacagaacgcaaatcatcgctggctggtgcgtacaacgtatgcagcatggcgaacagtggtcatggatggtcgtcgtgctggcggcaatgctgggacagattggtttaccgggcggcggctttggttttggctggcactataacggcgccgggacgcctggtcgtaaagggatcattttaagcggcttttccggttcgacgaccgttccgccagtgcacgacagcacggattacaaaggctacagcagcaccattcctattgcgcgttttatggatgccattcttgaaccgggcaagatcattaactggaacgggaaatcggttaaattaccgccgctgaagatgtgcgtgttcgccgggaccaacccgttccaccgacaccaacaaattaaccgcataattgaaggctggcgcaagctggaaacggtcatcgctattgataaccagtggacgtcgacctgccgctttgcggatatcgttttgccggctaccacccaatttgagcgtaacgacctcgatcagttcggcaaccactctaaccgcggcattatcgccatgaaacaggtggtgtcgccgcagtttgaagcgcgtaacgactttgatattttccgcgatctctgccgacgctttaaccgtgaagcggcattcacggaaggtcttgatgaaatgggctggctgaaacgcatctggcaggaagggagccagcagggaaaaggtcgcggtatccacttaccgactttcgaggtgttctggaatcaacaggagtacatcgagtttgatcatccgcagatgtttgtgcgccatcaggctttccgtgaagatccggacctggagccgttgggcacgccaagcggtttgatcgagatttactccaaaacgatcgccgacatgcaatacgacgattgtcagggccatcccatgtggttcgaaaaaatcgaacgctcgcatggcgggccgggatcgcagcgctggccgctgcacttacagtccgtccaccctgatttccgtctgcattcccaactgtgcgagtcggaaacgctgcgtcagcaatatgccgttggcggcaaggagccggtctttattaacccacaggatgccagcgcgcgcgggatccgcaacggtgacatcgtgcgggtattcaatgcacgcgggcaggtactggcgggagcggtagtttccgatcgctatgcgccgggcgtggcgcgaattcatgaaggtgcctggtacgatcctgataaaggcggcgatctcaacgcgttatgtaagtacggcaaccctaacgtattaacgctggataccggtacatcacagctcgcgcaggcgaccagcgcgcatacgacgctggtggaaattgaaaaatataccggtcctatggataacgtcacggcgtttaacggtccggccgagatggtcgcgcagtgtgaatatgtacccgcatcgcaggggaatccgcatgattaagcagccagcgcttgctcaggaacagtacgcctgcgtatatgcatggctggcgttactctttttccgggaagtggatgatgaagggttaatacaattacagtccgcggaaatcgcggactggctggcgctgttaaagcgtcagccagcgctggcggcgtcggtggcgttactcgaacaaaaaattgccgcgcttagcctgcgtcaggatgcgcagctggagctggccgcggatttttgcggattgttcctgatgacggataaaaaatcggccttgccctacgcctcgcaatacccgcagcaggaacccggcatgattaaacatttattgcttgaagccgggatggaagtcaacgacgattttaaagagccggccgaccacttggcgatttatctggaattactcagccatttacatttttcattgggtgaatcgttccaacaacggagaatgaataaattacgccagaaaacattatcgtcattactggagtggcttccggaatttacaaataattgccttaagcatgatccctatggtttttatgctgcgttaagtcaattattgttggctatcgttcgttttgatgacggaaaagaggatttatccattgttgcggttgaataaaccctgtgacgggcatcgcaaaataaatcttacgatagtcgggggttatcatatctataggtttagccaattgtaattattgataccaatcaatatccatgatgggtttgtatttagtattgacgggtctcatgagtaaaaaaataaaatttaattaattatgccgcaataccccataaggatagtgatatgaaaaaaattaccctctatgcgacaacggttatcaccgttgggctgttatgttatttaggtttgtccgggtatgtatggtattacgacaaacagcgcagtaaaaaaagcgatgtgcaggcctcggttgtgggtgaaaataataaaatactgggttatttcagggagaaaggatgtgattattgtcatacgccttccgctgaattgcctttttattcctcttttccggtggcaaagcagctaatggattacgatatccagctcggctacaagtcgtttaacctggaggcggtacgggccgccctgattgcggatacgccggtgccgcaaagcgaactgaataaaattgaatgggttatgcaacatcagactatgccaccaacccgctatgtcgcgctgcactgggcggggggcgtcagcgataaagagcgtactgacatcctgaactggatagccgatcagcgtgagcgcaactatgccagcgccgataccgaccccgcacaccggaatgaacccgttcagcctattccgcgcaatattcccgtcgatgcgaaaaaagtcgacttaggtttccgactttatcatgatgaacgtttatccggcgacagcacaatatcctgtgcgcattgtcacgcgttaaatgcgggcggtgtcgatggcagaaaaacctcaattggcgttggcggtgcggtagggccaataaatgcgccgacggtattcaactccgtatttaatatcgaacaattttgggatggtcgtgctgcaaccctgcaggagcaagcaggcggaccgccgttaaatcctattgaaatggcctctaaatcctgggatgaaattattagcaagcttgataaagaccctgtcctgaaaaaagatttccaggcggtttatccgcaaggatttaccggggaaaatattactgatgcgatcgccgaattcgaaaaaacgttgataacgccggattccgcttttgataaatggctacgtggagatgaaaatgcgctgaccgcgcaacagaaacacggttatcaattatttaaagaaaataaatgtgcaacctgtcacggcggtatcattttaggcgggcgctcttttgaaccattgggattaaagcgagactttaattttggcgaaattaccgcagcggatattggtcgtatgaacgtcaccaaagaggttcgcgataaattacggcaaaaagtcccaggcttacgcaacgtcgcgttaacagcgccttatttccatcggggcgacgtaccgacgctggatggcgcggtaaaactgatgctgcgttaccaggttggcaccgatctgccgcaaaacgatattgacgatatcgtcgccttcctggaaagcctgaccggtgtttatacgccatatcaacctgaatatgcgcaatgacaatgatgcttgaagccagagatctgtactgcgagcgggacgagaggacgctgtttcgcgggctgtcgttcaccgtggaggccggggagtgggtgcaggtcaccggcggcaacggcgccggaaaaaccaccctgctgcgcctgctgaccgggctggcgcgcccggacggcggggaggtgtactggcagggcgagcccctgcgccgcgtgcgcgacagcttccatcgcagcctgctgtggatagggcaccagccggggataaaaacccgcctgacggcgcgggagaacctgcactttttccaccccggtgacggcgcgcgtctcccggaggcgctggcgcaggccgggctggcgggatttgaggacgtgccggtcgctcagctctcggccgggcagcagcgccgggtggcgctggcccgcctgtggctgacccgcgccgcgctgtgggtgctcgacgagccgttcaccgccattgacgttaacggcgtggcgcgcctcacccggcggatggcggcgcacacggcgcagggcgggatggtcatcctcaccacccaccagccgctgccgggggccgcggacaccgtccgtcgcctggcgctgaccggcgggggggccgggctgtgatgtggcgtgtcttctgtctcgagctgcgcgtggcgttccgccacggcgcggacatcgccggcccgctgtggttcttcctgatggtcatcaccctgtttccgttaagcgtcgggccgcagccgcagctgctggcgcgtatcgcgccgggcatcatccaggtggcggcgctgctggcctcgctgctggcgctggagcggctgtttcgcgacgacctgcaggacggcagcctggagcagctgatgctgctgccggtgccgctgccggcggtggtgctggcgaaggtgctggcccactgggcggtgaccggcctgccgctgatgatgctctccccgctggtggcgctgctgctggggatggacgtgtacggctggaaaatcatggcgctgacgctgctgctcggcacgccggcgctggggtttctcgccgcgccgggcgtcgggctgacggccggcctgcggcgcggcggcgtcctgctgggcattctggtgctgccgctgagtgtcccggtgctgattttcgccaccgcggcgatggacgcggcatcgatgcatttacccgttgacggctatctggcggtgctgggggcgctgctggcgggcagcgcgacgttaagcccgttcgccaccgcggcggcgctgcgcatcagtacgcagtagcgccccggcacgacggacattttactggtttcaggaggtcaggtgacgactatgtggaaaacccttcatcagctggcggcgccgccccggctgtatcagatttgcggcaggcttgtgccgtggctggcggcagccggcatcattgtgctggccacgggctgggtccggggctttggtttcgccccggcggactaccagcagggggagagctaccgcattatgtacctgcatgtcccggcggccatctggtcgatgggtatctatgcggcgatggcggtggcggcgttcaccgggctggtctggcagatgaaaatggccagccttgccgtcgcggcgatggcgccggtgggggcggtgtacaccttcatcgcgctggtcaccggcgcggcgtggggcaaaccgatgtggggcacctggtgggtgtgggacgcgcgcctgacctcggagctggtgctgctgtttctctatgccggggtcatcgccctgtggcacgcctttgacgaccgtaaaatggccgggcgcgcggcgggcattctggtgctggtcggcgtggtgaacctgccggttatccactattccgtcgagtggtggaacaccctgcaccagggctcgacgcggatgcagctgagtatcgacccggcgatgcgctcgccgctgcgctgggccatcgccggcttcctgctgctctttatgacgctggcgctgatgcggatgcgcaacctgattttactgatggaaaaacgccgcccgtgggtgagcgaactgatactgaaaagggggcaccggtgagtccggcattttcatcgtggagcgattttttcgccatgggcgggtacgccttttttgtctggctggcggtggcgatgaccgtggcgccgctggcgctgctggcgctgcacacggtgctgcagcgccgggccattctgcgcggcgtggcgcagcagcgggcgcgcgaggcgcggatgcgtgccgcacaggcgcaacaggaggccgcgtgaatctgcgacgtaaaaaccggctatgggtggtctgcgcggtgctggcgggcctggcgctgaccaccgccctggtcctgtacgcgctgcgcgcgaatatcgacctgttctatacccccggcgaaatcctctacggcaagcgcgagacgcagcagctgccggcggtgggccagcgcctgcgcgtcggcgggatggtgatgcccggcagcgtcaggcgcgacccggactcgctgaaggtgaacttcagcctctacgacgccgaagggtcggtgacggtgagctatgaggggatactgccggacctgttccgcgaggggcagggggtggtggtgcagggcaccctggagaagggcaaccacgtcctggcgcacgaggtgctggccaagcatgacgagaactacaccccgccggaagtggaaaaggcgatgcaggaaaaccaccgccgcccgcaacgcgctgataaggacacttcatcatgatgcctgaatacggccacgcactgctgtgcctggcgctcggcgtggcgctgctgctgtccgtttacccgctgtggggcgtggcgcgcggcgacgcgcggatgatggcgtcggccggggtgttcgcctggctgctgttcatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgtttgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgttgtccatctgcgccttctcgctgtgtctgctgggcaccttcctggtgcgctccggggtgctggtgtcggtgcacgccttcgcctccgacccggcgcgcggaatgtttatcctcgcctttatggtgctggtcaccggcggctcgctgctgctgttcgccgtgcgcgggcacagggtgcgttcgcgggtgaacaacgcgctgtggtcgcgtgagtcgctgctgctcggcaacaacgtcctgctgatggccgccatgctggtggtgctgctgggtaccctgctgccgctggtgcacaaacagctggggctgggcagcatttcggtgggggagccgttctttaacaccatgttcacctggctgatggtcccctttgccctgctgctgggggtggggccactggtgcgctggggccgggaccggccgcgtaacatcaggaaactgctgctcaccgccctggtctccaccctggtgctgtcggtacttttgccatggctgctggaagatagaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggtatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccggggggctgctgatggcgctgggcgggctgctgtgcctggcggacccgcgctaccgccgccgtaaaccattgccggaggccggatgaaacgcaacgtactgttattaccgctgctgatttttctgctgattgccgcggcgctgctgtggcagctggcgcgcaacgcgcagggggatgacccgacgaatctcgaatcggcgctgaccggaaagccggtgccggcgtttcgcctggaatcgctggagacgccgggtcagtactatcaggcggaggtgctgacgcaggggaaaccggtgctgcttaacgtctgggccacctggtgcccgacctgccgcgccgagcatcagtacctgaaccggctggccgcgcagggtatccgggtggtggggctgaactataaggacgaccgggcgaaggcggtggcctggttaaaggaactgggcaacccgtatgcgctgagtttatcggacagcgacgggatgctggggctggacctgggcgtgtacggcgcgccggaaaccttcctcatcgacggcagggggattatccgctaccgccatgcgggcgatttgaatgcccgggtatgggaaagtgaactgaaaccgctgtgggacagatacagccgggaggcggcgcaatgagactgttaccgggcatggtgatgctgatgctggcgctggttatctccgggtcagcgcgggcgaccactgacgtgatgccgtttaaagatgaagcgcaggagcagcagttccgccagctcacggagcagctgcgctgcccgaaatgccagaacaacagcattgcggactcgaacgcgatgatagccaccgacatgcgccgcagggtgtatgacctgatgcaggaggggaagagccgccaggaaatcatcgattacatggtggcgcgctacggcaacttcgttacctacgacccgccgctgaccccgctgacggtgctgctgtgggtgctgccgctggccgccatcgtggcgggcgggtggataatcgtcgcccggacgcgccggcgggtgcgcctgcgccgggagccgctgccggcggacaccccggtttgcggcgcgcgcgccgggtggggcgtttacgtgccgggggccgtcattgcgctggcggtcggcgccggcagctacgccctgaccggcagctatccgcaggtgagggcctggcagcaggcaacggcgcagacgcccgggctgctggcgcgggcgctggacccgcaggcgcagccgctgaatgaggaggagatggcgcggctggcgctggggctgcgcacccgcctgcagaatgatgccggcaatgttgagggctggctcatgctggggcgcaccggtatggtactgggtaatgccggtaccgccaccggggcgtatgcgaacgcttaccgtctggacccggaaaaccgcgatgcggcgctgggctacgcggaggcgctgacgcgctcgtccgacccggaggataaccgccgcggcggggaactgctgcgtcagctggtgagccgcgaccacacggatatccgggtgttaagcctgtatgcgttcagcgcctttgagcagcagcgctttggcgaggcggtggcggcctgggagatgatgctgaagctgctgccggcgggtgacgcccggcgggcggtgatagagcgcagtatccggctggcgcaggagaaataagaccctgacggcccggtggcgtggcgccatcgggcctggctatcccaacgatacgctaaagcctgaaagtgaagcccgtgtgcagtatgatgacgagcatcgtctcttatcaggacatcccatgaaacaaatcacctttacgccgcgccatcaccagcttaccaataccaatacctggacacctgacagccagtggctggtctttgatgtgcggccttcaggcgcgtcatttacgggcaagactattgagcgtgtcaatgtgcataccggcgacgtggaggtgatttatcgcgccgtgcagggcgcgcatgtcggtgtggtgacggtgcatcctgccgacaattactatgtgtttattcatggccctgaaaaccctgatgagacgtggcattacgatttccaccaccgtcggggcgttattgcaacgccggggggcgtgactaacctcgatgcgatggatattactgcgccgtatactcccggcgcgctgcgcggcggcagccacgtccatgtatttagcccgaacggcgagctggtgagttttacctataatgaccacgttctgcatgagtgcgatccggcgctggatctgcgtaatgtcggcgtggccgcgccgtatgggccggtaacggtgccagttcagcatccgcgcgaatacagcggtagccactggtgcgtactggttagccgcacgacgcctgcgccgagacctggcagcgatgacattaaccgcgcctatgaagagggctgggtgggcaaccgccagatcgcctttattggcgatacgctgtcgctgacgggccaaaaagtcccggagttgtttattgtcgatttaccgtgtcatgaaaacggctggaaacaggcaggcgacacgccgctgacgggaaccgaatcaacaatgccatcgccgccgttgggcgtagttcagcggcgtcttacctttactcaccagcgtgtttatcctggactcactaacgaaccacgccactgggtacgcagtaatccgcaggcgacggcgatcgcctttttgatgcgggacgataacggcgtagcgcaactgtggctgatatcgcctcagggaggcgagccccggcagttaacgcatcatgcgaccggcgtacagtcagcgtttaactggcatccgtcgggtaaatggctgggactggtgctggaaaatcggattgcctgctgcgacgcacaaagtgggaagatcgacttcttaaccgccaggcacgacaacccgccgtctgcggacgccgtcgttttttcaccggatgggcgacacgtcgcatggatggaagaggtgaaaggtttccgtcagctatgggtgacggaaaccgggcgataaatcagggaggaggcatcttcgccggggggatgacggcattggtcattttcgtctcctcctcgcttttctcgacgcgcgatcttaccgaactgtctttgcggaagatgtcccacggcagaaggatcgtatccatcacggcggtaaacggcatatccaggatggccaacgatttggtgccccagtttgtctcatcgttaccgatcatcgtagcgctggcgcgcgtgccaggataagtaccctctttaccgccggtgtgcgacatgacgcttgaacaaccgcctaataaaagcatcccattccatattatcagcgttaaccacacgttttttatcatcactcattcatctgttggttgtcgttatttgcatgatgagttatagcgatccgttgctaaaaataacatcaccagtacgtggcactgtggcggtaatcgcactttaacaatcagtgctgtcccaaccagtctatgcaatagccaataaactgcaaaaaaaagtcggattaaaatacttgaaaagtacgtattcagacccatttataagacgtagtgaatagaagggcacgcctgatgggtgttctggcaatcctggcctgtccatgatggaaggtttgacattctcgctgatttcaggagtttatgattatgcgtaactttgatttatccccgctgtaccgttctgccattggttttgatcgtctgtttaacctgcttgaaaataaccaaagccaaagtaatggcggctaccctccgtacaacgttgagctggtagacgaaaaccactaccgcatcgccattgccgttgccggtttcgcggaaagcgaactggagattactgcccaggataatttactggtggtaaaaggcgctcatgcggacgagcagaaagaacgtacttacctgtatcagggcattgccgagcgtaactttgagcgtaagttccagttagcggagaacattcacgttcgtggcgcaaacctggtcaacgggctgctgtatatcgaactggagcgcgtgattccggaagcgaacaaaccgcgccgtatcgaaattaactgattccgtcgggtcgcgttgcgcggcctgtcatcccatgctcgccgtcagggagcatattcgcacgtaaagtgtgaaggtaaaaactcgcttcttagaaggagaaatgattatgcgtaactacgatttatccccactgttgcgtcaatggatcggttttgacaagctggccaatgcgctgcaaaacagcggcgaaagccagagcttcccgccctataacatcgaaaaaagcgacgataaccattatcgcattaccttagcgttagccggtttccgtcaggaagatctggatattcaactggaaggcacgcgcctgacggtgaaaggcacgccggaacagccggaaaacgagcccaaatggttacatcagggcctggtcatgcagccttttagcctgagctttacgctggctgaaaatatggaagtttccggcgcgacgtttaccaacggcctgctgtatattgatttaacccgtaacgagccggaaaccattccgccgcagcgtatcgccattaacgaacgctccgcattaaatagctaataagctccttgccttgccccgccagagatggcggggcttttttgtgccacgaaaaagggtaagacgttgccgaagtcaggacgtctgtgcggttttgtaatatgagaatgtgcgccatgctgtatatatgccttaacggttcagtcataatccctataaattgaaatgttactcacagggaagagaagatgagatgagtgatatcgcattgacggtcagcgttctggcgttggtggcggttgtcggtttatggatcggcaacattaaagtgcgcggtgtcggctttggtattggcggtgtgttgttcggcggtattatcgtcggccacttcgtcgatcaggctggggtgacgctgagcggcgatatgctgcactttatccaggagttcggcctgatcctttttgtttataccatcggcatacaggtggggccggggtttttcgcctcgctgcgcgtttccgggctacgtctgaatctgtttgccgttctgattgtgattatgggcgggttggtcaccgcgattctgcataaaattttcgctattccgctgccggtagtgctggggattttctccggcgcagtcaccaatacgcctgcgttaggggcgggtcagcaaatcctgcgcgatctgggaacgccagtggatctggtagatcagatggggatgagctatgcgatggcgtatccgtttggcatctgcggtattttgctcaccatgtggctgatgcggctgatttttcgcgttaacgtcgaggcggaggcgcagaagcacgaatcctctctcgctaacggccattcattaattcagacaatgaatatccgtgtcgagaatccgaacctcaataatatggctatccaggatgtgccgatcctgaacagcgataaaatcatttgctcacgcctgaaacgcgatgacacgctgatggtgccgtcgccggggacgattatccaggcaggcgacctgctgcacctcgtcggccaacctaccgacctgcataacgcgcaactggtgatcggtaaggaagtggacacctcgttgtcgacgcgcggcacggatttacgtgtcgagcgtgtggtcatcaccaacgaaaaagtgctcggcaaacgtatccgcgatttgcactttaaagagcgttatgacgtggttatctcccgccttaaccgcgcgggcgttgagctggtcgccagcagcgacgctagcctgcagtttggcgacattctcaatctggtggggcgtcctgcctcgattgatgcggtagccaatgtggtcggcaacgcgcagcaaaaactccagcaggtgcagatgctgccggtgtttatcggcatcggattaggggttctgcttgggtcaatcccgttgtttgtgccgggattcccggtcgcgttaaaactggggctggccggcgggccgttgatcatggcgctaattttggggcgtatcggcagcatcggtaagctgtactggtttatgccgccgagcgccaacctcgcgctgcgtgaattaggcatcgttttgtttctggcggtcgttggactgaaatccggcggcgattttgtcgatacgctgacacagggcgaaggattaagctggattggctacggtattttcatcaccgctattccgctgattaccgtcggtttgctggcgcgaatttttgccaaaatgaactacctgacgctgtgcgggatgctggccggttcgatgaccgatccgccagcgctggcatttgccaacaatcttcatgccaccagcggcgcggcggcgctctcttacgcgaccgtctatccgttagtgatgttcctgcgtattatcacgccacaactgctggcggtgattttttggggaatgggttagcgcctgatggcgcgttgcttatccggcctatgcactgtgttaaatccaggctggataacgcgcgccgcaccggtcacacttctgctcttcttcttatctctttcctcaatgaacgtgctaatcagcgtaatggcaacgagcataattccaattttttcagttagttatcaatcttcatcgccttttttttcgtcgcaacgggtagtttttcagcttttaattcggcaataatgcctttcctggcggtggcgctgaaaaaggtcgcaactgaaatgaaaaatagcggcaatgagcgcggttgcgccgaaacacgtcaccagtgaactacagttattttgcaataagattcccttgctgcgggataatgtgaagcatatcagcaacaacgtgagtggtattctgaaaacgaacgggaatacataagaacgtaaaaggagtcgtcatgaagatttcccgcctcggagaagcgccggattatcgcttctcactggcaaatgagcgcacctttctggcgtagattcgcacctcgctgggatttctggcggcaggcgtcggtcttgatcagctcgccccggattttgccacgccggtgatccgtgaactgctggcgctactgttgtgtctgtttgcgggcggcctggcgatttatggctatctacgctggttacgtaatgaaaaagcgatgcgcctgaaagaggatttgccttatacccatagcctgttgatcatcagcgttattttgatgattgtcgcggtgatagtgatgaggctggtactgtatgccggatagtcgtaaagcccgtcggcagaacgatccgggactgcaaccggagcgtacgtcgctggcctggtttcgcacgctgctgggatacggggcgttaatggcgttagccgtcaggcactactggcatcaggcggggttcttgttctgggtgtcaatcagcgttctggcgatagtggcggtgattctttggcgttataccctgagtcgtaatttgatggatgtcgcgcatagcgatttttccgaaactcatgtcatgcgtgacaaatttttgatctccctcgcggtgttgtcgctcgcaatcctgtttgctgttacccatattcgccaacttattgcatttatcggggattttatatgacaggacgtcaggacattgtcgtgagtaatgaccagattcaggtcgtcgtaaatcgccagaatagccagcgccctcagcaactgtaccgtaacttacaacggctcggcattcgcaatgtccattttatcccattgttggaacatgaccggaacggaatgttgaccgaggattcattgtgttcagcagactgggggcggtttttaaatagcgtatttgatatttgggtacgtgaagatattcagcgtatctcggtccgcctttttgatgagacgctacagcagtggtgcggcggcaggaatggcgctaaaacgccggacaaggcgccgctaagcgctgaatgtcagaagtgctctttattacgattttgcggcggcggatgccctgagcatcgggatagccaggggaaaaatcagctttgcgagggctaccagaccttttttaactactcctcgccgcatatgcgggtgatgcgggatttactgaaacagcatcgctcgccggaggagttgatggcgatgctgcgttaacgtcacaggcctgataagcgtagcgccatcaggcgatggcgtgccggatggcgctgccgtctttccggcactaagcgagtattagcgtccttttgccaggtattgttccatttcatccttcggcaccatgccgcccccggttgcccatatcagatgcgtcgcgttgccgagctgcgtctgactgaatccatgcctttgctgatacgcgacggaggcgcaaatgcgctgtggcccggccatccccgccagagctgatggctccagtcgaattccttcctcctgcgccagccagcccagcatgtcatacattgtttgatcgtctaaggtatagaggccgtcaagcagacgctccattgcccgaccaacaaagcccgaagcgcgacctaccgccaggccgtcagccgccgtcaggttatcaataccgatatcttgtactgagatggcatcgtgcagaccggtataaacgccgagtaacatgcagggtgaatgggtcggttcggcaaagaaacagtggacgttgtcgccaaacgccagtttcaggccaaaggcgacgccgccagggccgccgccaacgccgcacggcagataaacaaacagtgggtggctggcgtcaacgacgcgtccctgctgcgcgaattgcgctttcagacgctgacccgctaccgcatagcccagaaatagcgtgcgagagttttcatcatcgataaagaaacagtttggatcggattgcgctgctttacgaccctgctcaaccgccacgccgtaatcatcttcgtattccacgaccgtcacgccgtggctacgcagcttcgcctttttccaggcgcgggcgtcggcagacatatgtaccgtcactttaaaaccgatgcaggcgctcatgataccgatcgatagccccagattgccggttgaaccgacggcgatactgtactggctgaagaattgtttaaattccggcgaaagcaacacgctatagtcatcgtcggtggttaacagacccgcctccagcgccagtttttccgcgtgcgttagcacctcgtagatgccgccgcgcgctttaatggaaccagagattgctaggtgactgtctttttttaatagcatttcaccgtcgatcgtttgcccatactctttttccagccgtttttgcatggccggaatagcgaccacgtcagattcgattatgccgccagcggcagcggtttgcggaaacgcttttgccagatacggcgcaaagcgcgccagacggtcatgggcggcgtttacgtcctgctccgtcaggccgacatacggtagaccttgtgcaagagaggtggcgcccgggttaaaccaggtggtttctttgagggcgaccagatcctcgaccaaaggataccgggcgatgagctttagtatgttttccatagtacgtctctttacgatcagatgataaaggaaagcaggaatgtgccagccagtgcaacgacagatgcgataaacgtggccgtcgtatagtatttaaacgtttcattcagcgtagcgccgcaatactgcttgaccagccagaacagggaatcggtcacgatcgtgcagccaatggtgtcggaaccgatggcaatagcgatgatctccgggctaacgtcaggatagagcggcagcatgggcgcaacaatcgcggtggcgcccatcatcgccaccgtcgcagagccgaccgccgcgtgcagaatcagcgctaccagccatgccagcagaatcgggtgcatatgcatatttgagaggatcaccgccagcgtgtccgccagtccgctacttttgagaatggcgttgaacgcgccgcccgcgccgataatcagcaggatgttcgcaatggcgccaaagccgttttcggtgtgggtaagtagcgcgctcatacccatatgctggcgcagaccgagtatgtaatacgccacaaagacagcgataaacatcgcggtgatcggattaccgataaactccagcagcgtatacaacgtgccgtctttcgccatattcagttcagcgacggttttcaccagcatcaggccaatcggcagcagaacggtaaacagcgttgcgcccagcgacggcagggtgttttcggcacgcacttcaagatccgcaaactctgtcggtacgggcttgaacggcagacgattacccagaaactttaagaacagcgggccgccgaccaatgaggccatcagtccgaccagcagaccgtagacaatcaccgagccgatatccgcccccagtttatttgcgacaaacagcgcagccggatgcggcggtaccacgcaatggacggccatcagcgcggtacacagcggaatggccagcttcagcagcgaggtatgggtctttttagcgatagaaaacgccagtgggatgagcaacacgacgcccacttccacgaacaacgtgattccgcaaatcagccccaccagtaccatgatcacgtcagcagagagccagcggcagcgctggagcgtaagcccgatgcgttccgccgcgccggaaacctccatcattttgccgaggatggtgccaagaccgataacggcggccagaaaaccgagcgtaccgcctattccgttttctatcgccgtgaccatctccagcggccctatgcccatcatcgcgccgacaaagaaactggcgagcagtaacgccaggaaggggtggaatttaaacttcacgatggtcaatacgattaacacgatgctgatcagcagcgtgctcactacccagatttgagcgtgcatatctcacctaccctgtgattaatctgttcttattggacagaaaaacagcacaccctgacaaacgatataatttgccattcacatgatgtaaattgaatcaactatgtgatttccatctaatattgcctttattttgcgatatggttcattttacttcatctatgtgcggattttttcagcgcgtttttttacacttcgggaaattaaaagatgactgaggttgccatggaaccccttcgcgatacccgaaaccgcttactcaacggctggcagttatccaaactctatacttttgaagtcgcggccagacaccagtcctttgctctggcggcagatgagctgtcgttaagccccagtgcggtaagccatcgtatcaatcaactggaagccgagttgggaatccagctatttgtccgctctcaccgtaaagtggagcttacccatgaaggcaaacgggtattctgggcgctgaaatcgtcgctggatacgttgaatcaggaaatcctcgatatcaaaaatcaggaactgtccggcacgttgaccgtgtattcacgcccctctatcgcccagtgctggctggtgcccgcgttgggggactttacccgtcgctatccgtcaatttctctcactatgctgaccggcaacgataacgttaacctacagcgtgccggcattgacctggctatctattttgacgatgcgccgtcggcgcagctcacgcaccattttttaatggatgaggcgattttgcccgtttgcagcccggattacgcccgtcgtttcgccttgcaggacaacctgaataacctgcggcactgtacgctcttacacgacagacaggcgtggagtaacgattctggcaccgatgagtggcacagttgggcgcagcattttgcggtaaatttgccggattcatccggcattggcttcgatcgttctgatttagcggtgattgccgcgatgaaccatattggcgtggcgatgggacgtaaacgactggtgcaaaagcgtctcgacagcagtgaactgattgcgccttttggtgacatgagactgaaatgtcatcagcattattatgtcaccactctgcctggcaggcagtggccgaaaatcgaggcatttattcgctggttgcaggaacaggtgtgaagatttattacgctttgccgctacacctgccgggagtgaatatgctaaatacgtgctatcaccgtggtaaaaattttagggggcgtcgtgtttaaaccgcttattgcctctctcatactgaccagcgcggtcgtctatgcgaaaccgatgcctttgacggcggcgcgctatgcgcagcagcttggcgttgggatggatgttgactgggcgcgaacggaacggggtattcgcgagtttgatccgttggtcgtgcgggattttaaggcaaaagggttaacgcatgtccgtattcgtgtggcaggcgcgccgacggaagcgcgcctcatccatttgcgtaagctggtagaggcctgcgaatactatggcgtcatacccattattgcctatcaggcggatgcgtataaaaccgatcccagcgccagccatgaaaaggagctgatcaactggtggagcgtggtcgcgcgctattttggtcagacatccccgcttctggggttcgatctcatttatgagcctgccgacaaacttaatcataatatggcgtcgctgaatcgcgtatatgacaaaaccatccgcctgattcacgccattgacccacagcggatgattttcgttgccccccgcatgcgcgccgcgccggaggatttatcggcgcttaaactgccggcgcaaagccagaactatgtactggcggagtggcacatcttcccgtggggacccctgaaaagcggcggtaaatatccgtggacgtcaggcacgacggcggaaaaagcggcgattcgggcacggattaatgccgcggttcgctggcagcataagaccggccatgcaagctgggtgggcggatgggcgccgggagagtcgataaaaatgacgccgatcgcttcacagttcgcgtttgcccgttttatggcctgcgagctgaaaaaagcgcatattccgtatgcgataaacgcggacactcagttttatgacggcgaagaaggagcgtggcgtccggcgcaggagcccctgctcaatgcgatgatcgcgccggaatgtgaaacgcccggcaaaaagccgggcgaggggaatgttaaaccgtctgtccctgatgcgatatccgtgacgccagcggcagccagcacgccaagatcagcaatcccataagggtcatcagcaatcccagactgccctgaccggtttgcggcagcattgccgaaagccacgccagtacgccggaaccaatattttgcagcccgccgaccagcgcgccagcggtgcctgcgaggaacggaaacggctccatcgcgccgctggtggccagtggaaataacatcccggcgccgaagaaaaacagcgcagcggggatgagtagcgtccagacgttcatcacgccaaaccagccgggaatccacatcataaggcctgccagcagacagcaaataactgactgccacatcagggctgagaagcgtttattcgggcgtccggcaaaccaggcgccgaagaacgccgccggaatcggcagaataaacagaatgcttaccaccatactgctgagacctaatactgctcccatcagcacgccggaacaggcttcaaagaccgcaatgccagccagcccgccgattagcatcagcaggtaacagttaaatgcgccgttgccaaacagcgtcttatagctggcgatcagccgcgtacgcggcgcgccggcggggcgggtttccggcatccagcgcgccatgctgaaggtgacgccagcgcaaagcaccagcaggaaagcgtaacacgcgcgccagttccacagggtatccagcaggccgccaatcagcggcgctaacagcgggctgaccagaatccccatatttaacaggctattggcatgacgaagttgcgttccttcatacagatcgcgcgggagcgttctcgccattactccgccaacgccggttcccatcccttgcatggcgctggcggcaatcaacaccgtcaaactatgcgtggtcatggcgatcagagtcgctaccataaaaatagacatgccgacgaggattaccgggcggcgcccaacccggtcggaaagcgggccgtaaaacagttgcgagacgccgtaggtcaggaggtaagcagccattacgctctggacggcgccttcccggacgtttagcgcttgtgccatatcggcgatggcgggaatataaatggtttgcgccatctgccctacggccaccagtaacaccaacatcaacaacaaattgacgtttctctgccttttcatttcgctgattacttttcaaaaaaagaaaaaataagaataacttgctgcgcattcccataaatgcgagaggaatctatcacaccagaaaaagaaggccagacagcaaccagcaatggcagacgaaggaacggcaggatatgtaaacaaaagcggcaacaaatgttgccgagaatgtgttacgtctgcagctgttattgggcaatcatgacagacggagtaaaatcgccccgagggcaatcccgcccgccgccaccagacgtagcccggccactttctctttaagcaacagccaggctatcagcgcgccgaataaaatcgacgtctcacgcagcgcggcgaccaccgccagcggcgcctgggtcatggcccatagcgccagcccataagatcccatagtgccaatcccgccaaaaatgccttttttccactgttgcgccagataacgcgacgcttcccgccgccgcgcaatcatcgcccaagttaacaggcaggcgccgttgagaaaaaatgaccatagcgtatagcccagcgccgtttcggagagtcttacgccggtcccgtccaccagcgtatatccggcaataaaacaggcgttagttaatgccagcacgacaccacgttgagagctggcgcggccattacaggccatcccaagtatcgccatgcagatcactgcgatgccgacctaggccatcgacgacaggctgtcgccaagaaacagaacgctaatgagcgccaccagcagcggcgcggtgccgcgcataagaggataggtctggctcatgtccgagacctgataggttttcgccaccaggacggtatacaccacctggagcgcggtagaggccgctaaaaaagggatactggcgtgagctggctgcggcgagaagggcaaaaggatcaatgccatgaccgccgcggaaccgctgacgccgatcgcggcgtagagcttatcgtttcccgctttgacaatggcgttccagctggcatgtagcagcgcggcgaacagcaaaatgcagaaaacggaaagggtcatagcatcaggcgtcgttgagggtgtcataaaaacgtaacatacccgggaagcgaaagaccagcggataaggtgaaaggggagcggttgcccgttccccttcggtgcggcttgaatctgaattacttaaggtatttcagaacagcatcaagcagttgcagtgctgcaacaatgagtttcaggataagaatggtgatatccactacgctcatacgcgtctcctgtggttaaggagcactgccagccgacgtacctttccgctgcctgttgccagctgttgcgcacgcgatcccttttgcgaggaatagtgtgcgtgttgacataacacagtgtgctcacgagggggttaaggcgctgacggcaccacccgtttcagccaggacttcgttgcgccggtttacgatgcggcccccgcataacacattgtgtcaaagacattatagttaagtgctgtataaatgaacagtaatttatagacagaacggagcttctgatccatactcaaattcatcaaaattcgcgccgaaattgcgcgttctgcacagaacgcgtatacttctgctgttgacataacacagtgtgcttcgcggctaccacccgcattacgctgtaagaacctcgcttcggcgaggttttttgttttcaggcattgtgaaacgcgtgatcatcaatcccggcgattaccggagggcgctacgcttatcacgcctatactcaaagcgtgtaaattcgtagaaaaatgtgatcgctgacgcatttttgtgcagatgaaaatttttccgttgtcatgctgaaagcgctgtgcttgtataaaacgtgttaataacaaacagacaaggcccctaatgaacccttccatgctgaacgcgaccctactaacaactgcgccatctcgcgcagtggtcgtcgtgcgtgtggtggtggtcgtcggcaatgcgccgtagggtccggaacacacacgattccaaaaccccgccggcgcaaaccgggcggggttttttgtttaagacaccttcccggaacgtcggctcagaataaaaggaatggagcatggcaagttcgggcacaacatctacacctcagcgctttacgggcgcggaatttatagttcattttctggagcgccaggggattcgtatcgtcaccggcattcccggcggttcgatcctccccgtttacgacgcgttaagccaaagcacgcaaatccgtcatattctggcgcgccacgaacaaggcgcggggtttattgcgcaggggatggcgcggacggagagtaaacctgctgtttgtatggcctgtagcgggccaggcgcgaccaatctggtcacggctattgccgatgcgcgcctggattccattccgttaatctgcattaccgggcaggttccggcgtccatgatcggtactgacgcgtttcaggaagtggatacctacggtatctctatccccatcaccaagcacaactatctggtcagaaatatcaatgagctgcctcaggtgatgagcgatgcttttcgtctggcgcagtcggggcgtcctggcccggtgtggatagacgttcctaaagatgtgcagacggcgaccattgagctggatgcgttgccgtcgccggcggaaaaatcacccccgccggagtttagcgcggagagtatccgcgaggccgccgcaatgattaacgcggcgaagcgtccggtgctgtatctgggcggcggcgtgatcaatgcgccgacacgcgtgcgcgaactggcggaaaaagcgcaactgccgacgacaatgaccttaatggcgctgggaatgctgcctaaggcgcatccgctgtcgttaggaatgctgggaatgcacggcgcgcgcagtaccaattttattctgcaagaggccgatttactgattgttctgggcgcgcgttttgatgaccgggcgattggcaaaacggagcagttttgtccgaacgccaaaatcatccatgtggatatcgatcgcgccgagttaggcaaaattaagcagccgcatgtggctattcaggcggatgtcgatgatgtactggcacagttaattccccatatcgaggcacagccgcgggaagcatggcatcagttggtggcggacttgcagcaagaattcccttgcggtattccccaggaaaataacccgcttagtcactatgggctgattaacgcggtcgcagcctgtgtggacgacaacgcgattattaccactgacgtaggtcagcatcagatgtggaccgcgcaggcttatccgctcaaccgtccgcgtcagtggctgacttccggcgggctgggcaccatggggtttggtctgcccgcggcgattggcgcggcgctggcgaatccgggcaacaaggtgctgtgtttttccggcgacggtagtttgatgatgaatattcaggagatggctaccgccagcgaaaaccagttggatgtgaaaatcatcctgatgaataacgacgcgctgggactggtgcatcagcaacagagtctgttctataaacagggcgtttttgcggcaacctatccgggaagcatcaactttatgcagattgccgccgggtttggtctggacacctgtgatttgaataacgaagccgatccacaggcggcgttgcaggctatcattcgtcgtcctggaccggcgttgatccacgtgcgcattgatgcagaagaaaaagtgtatccgatggtgccgccgggtgcggcaaatacagagatggtgggggaataagccatgcagaaacaatcacatgataacgttattctggagctgaccgttcgcaaccatcctggcgtgatgacccacgtctgcgggctgttcgcccgacgcgctttcaacgttgagggtattctctgtttaccgattcagggtagcgatcagagccgcatctggcttctggtcaatgacgatcagcggcttgaacagatgataagtcagatcgataaactggaagacgtggcgaaggtggtacgaaaccagtccgatcccaccatgttcaataaaattgccgtcttttttgagtaagttattcactttccgaatcaggcgtgatgactttgacggaaccattccgacagtgaacggcataatctgtcggtaatgggcgatcgctaatcaggacatcaaaggcagaaagcggaccaatgctggcaggcgcgacctcatcaaacagggcgtgacgcgccagcaaaattttgcgcagaccgcgctccatcgctttacgtttggcggcaagatcatccgggttaaaccagctcacgccaaaatgttcatgtacgccgctggcggaaataaacactttgcgcggattaagcgaatccagcgccgaaggattattggcatcataaaaggcatcgctcttggcccgataggtgccgccgcacagaatcgctgtggcattaggcttttcattcagcgcgataaatacccgatgcgagtagcaaatcccggtaaaggtaatatcatccggtatcatgctgatgactaatggcatttccggaccgttatcaaaaaaaaccagatcgttttcacgcaccaggccggcggccaagatcgcaacgggaaggtcgtcccgatgatgcgtctttttcgccggcagcggcatattggttgaagacgcaggcttatttaccatgacgatatagccgccgagcagcgtcagcggtaaagggtcatcatcctggctgagatcgcggcgaatggtcatcaccgaaacttccagcatccgcgcggcgtctttcagatggattcgatcggtctttttcagtaactccatcaagcgtcggatacgttctttttgcttggtctccattcaccctctccgcaaatcatgttgttatgttccatcagtaacatttatgtgtttctgagaacattacagtgtggcactactatacgtctggccgtcaggaaataaaagtgggtttattcgcgttttataacaataaatagttaattttcagtaaattgtaaccctaaaaatgatttgttccgccaggggttgttcacgaagtaaatggcaaaatgatcctctaatcgcgatcatagtcacaaatgatacggaagtaacatgataatgttattttaatatcattgtcgtgtgacgatttctgagagggagtaaaatggatatcgcggttattggctctaacatggtggaccttatcacctacaccaaccagatgcccaaagaaggggaaactctggaagcgccggcgtttaaaatcggctgcggcggaaaaggggcgaaccaggccgtggcggccgctaagctcaattcaaaagtattgatgttgaccaaagtgggcgacgatatttttgccgacaacaccattcgtaatctcgaatcctgggggatcaatacgacgtatgtagaaaaagtaccgtgtaccagcagcggcgtagcgccgattttcgtcaacgccaactccagcaacagcattctgatcatcaaaggcgctaacaagtttctctcgccggaagatatcgatcgcgcggcggaagatttaaaaaaatgccagcttattgttctgcaactggaagttcagcttgaaacggtttatcacgcaatagaatttggcaagaaacacgggattgaagtgttattaaaccctgcgccagcattacgggaattagatatgtcttatgcctgtaaatgcgatttctttgtacctaatgaaaccgagctggaaatattaaccggtatgccagtggatacctatgaccatattcgcgcagcggcacgttcgctggtagataaagggctgaacaatattattgtcaccatgggcgagaaaggcgcgctgtggatgacgcgtgaccaggaagtccatgttccggcgtttagagtgaacgctgttgataccagcggcgcgggcgatgcctttatcggctgtttcgcgcattactacgtccagagcggggatgtggaagccgccatgaaaaaagccgtcctctttgccgctttcagcgtcaccgggaaaggcacccaatcctcttatccaagcattgagcaatttaatgagtatctttcgttgaacgaataacaatcaccctgcactgttaaaggtagcactatgaacgataaaaacatcgttcagatgcccgacgggtatctgaataagacacctctgttccagtttattttgttatcctgtttattcccgttatggggatgcgcagccgcgttaaatgatattctgattacgcaatttaaaagtgtattttcgctgagcaactttgcttcggcattagtacaaagcgccttttatggcggttattttttaattgctattccggcctcgctggtcattaaaaaaaccagttataaagtggcgatacttatcggcctgacgctatacattgtcggctgtacgctcttttttccggcgtcgcacatggcgacctacaccatgttcctcgcggcgattttcgccattgcgattggcctgagtttcctggaaacggcggcgaatacctacagttcgatgatcgggccgaaagcctacgccacgctgcggctgaatatcagccagaccttttatccgatcggcgcggcggcaggcattttattgggtaagtatctggtcttttccgaaggggaaagcctggaaaaacagatggcgggcatgaatgccgagcaagtccacaacttcaaggtgttgatgctggaaaacactctggaaccctataagtacatgattatggttctggtagtggtgatggtactgttcctgctgacgcgttttccgacctgtaaagttgcgcaaaccgcgagtcataaacgtccctcggcgctggatacgctacgctatctcgccagtaacgcccgcttccgtcgcggtattgtggcgcagttcctgtatgtgggaatgcaggtggcggtctggtcgttcactattcgtctggcgctggagttaggcgatatcaatgagcgcgatgcctcaacctttatggtctacagcttcgcctgcttttttatcggcaagtttatcgccaacattctgatgacgcgcttcaacccggaaaaagtcctgatcctttactctgtgatcggcgcgctgttcctggcctatgtggcgctggcgcccagctttagcgcggtatacgtggcggtgctggtcagtgttctgtttggcccctgctgggcgaccatttatgccggaacgctcgataccgtcgataacgagcataccgaaatggcgggggcggtcatcgtgatggcgattgtcggcgcggcggtggttcccgcgattcagggctacgtggcggacatgttccactcgttacagctctcattcctggtttccatgctgtgctttgtttacgttggcgtttacttctggcgcgaaagcaaagtgcgcggcaacctggctgaagtcgccgcgtcctgaggagatcaaccatgacaacacgtattacattatggcgggagctttttagcgagcagccgcgtatcttgctggaaaatgacgattttacggttacggcgtttcgttacgccagcggcgtggaaggactgaaaatacaaaacagccgcggtcatctggtgattctgccctggatggggcagatgatttgggacgtgcagtttgacggtcatgatctgactatgcgcaacatgttccgccagccgaagccggctgcggaagtggtggcaacgtatggttgctttgctttccattccggactattggcgaatggctgcccgtcgccggaagatacacatccgctgcacggcgagatgccctgcgctgctatggacgacgcctggctggagttagagggcgacagtctgcgcgtgaccgggcgctacgagtatgtgatggggttcggtcatcattatcaggcgcaacctgcggtggtaatgcgtaaatcaagcgcgctgtttgatattcagatgaccgtgactaacctggcttcagtcgccatgccgctacagtacatgtgccacatgaactatgcctatgtgccgaacgccacgttccgccagaatatcccggataccgcgctgaagctacgcgagtcggtgccagcgcatgtcaaacccacggcgcagtggctggcgtttaatcaacgacttttgcagggtgaagcctcgctggcaacgctcaacgagcctggcttttacgacccggaaatcgtgttcttcgccgatgaactggacaagtacacggataccccggaattcagtatgatcgccccggatggcaccacgttcgtgacacgtttcgccagcgcggagctgaattacgtgacccgctggattctttataacggcgatcagcaggttgccgcctttgccctgcccgcgacctgtcggcctgaaggttttctcgcggcgcagcgaaatggaaccttgcttcaactggaaccgcagcaaacccggacgttcaccgtcacgacaggcattgtctgaccgctcaaggcttgaacacccaggcacttatcgttaaggtaagtgcttttgccggatggcggcattaatgccttatccggcctacaacggcacctgcccgtaggcctgataagcgcagcgccatcaggcatgtcttagcgccaggatgaacccatgattaccgttgcccttatcgacgaccaccttatcgtccgctccggctttgcacagctactggggctggaacccgatttgcaggtggtcgccgagtttggttccgggcgcgaagcgttggcaggcttgccggggcgcggcgtacaggtgtgtatctgcgatatctcgatgccggatatttccggactggagctgctaagccaactgccaaaagggatggcgacgatcatgctctcggttcacgatagcccggcgctggtggaacaggcgttgaacgccggcgcgcgcggttttctctctaaacgctgtagtccggatgagctgatcgccgcggtgcatacggtggcgacgggcggctgctatttgacccccgatattgccgtgaaactggcggcgggtcggcaagatccgctgaccaaacgcgagcgtcaggtggaggaaaaactcgcccagggtatggcggtaaaagagattgccgccgagctggggctgtcgccaaaaatggtgcatgtccatcgcgcgaatctgctggaaaaattaggcgtcagcaatgacgttgaactggcgcatcgcatgtttgacggttggtaatgaacacctttttttcccgtttaatcaccgttgttgcctgcttttttatcttctccgccgcgtggttctgcctgtggagcatcagcctgcatctggtagagcgcccggagctggcggcgctactctttcccttcggcctgcgcctgggacttatgctgcaatgcccgcgcggatactggccagtattgctgggcgcggagtggctgctggtgtactggttggcgcaggaagttgcgctggcccatctgccgcttttgatgatcggtggtgtgttgacgctactgcccgtggcgctgacttctcgttaccgccatcagcgcgactggcgcacgttattgcttcagggcgcggccctcaccgccgcggcgctactgcaatccctgccctggctggggcagggggaagcggcatggaacgcgctactgctgaccctcacggggggactgacgctggcccccatctgcctggttttctggcactatctcaccagcactacctggctgccgctgggaccatcgctggtatcgcagccggtaaactggcgcgggcggcatctgatctggtatctgctgctgtttatcgtcagtctgtggctgcaactggggttacctgctgaactttcgcgcttcacgccgttctgcctggcgttgccgattatcgcgctcgcctggcattatggctggcagggcgcgctcattgccacactgatgaacgctatcgcgctgatcgtcagccagacctggcacgatcatcccgtcgatttattactttcgctgttggcgcaaagcctgaccgggctactgcttggcgcgggcattcagcgcctgcgcgagctgaaccagtcgctgcaaaaggagctggcgcgcaaccatcggctggcggagcgtcttctggagaccgaagagagcgtacggcgcgatgttgcgcgtgagctgcacgatgacatcggacagaccatcaccgcgattcgaaccctggcgggcattgtgcaacgactggcggcggataacggcggcgtgaagcagagcgggcaacttatcgagcagctttcgctgggcgtgtatgacgccgtgcgtcgcctgctggggcgcttgcgcccgcgccagctagacgacttaacgctggcgcaggccatccgttcgctgctgcgcgaaatggagctggaaagccgcggtattgtcagtcacctcgactggcgaattgacgaaacggcgctaagtgaaagtcagcgcgtgacgctgtttcgcgtctgtcaggaagggctgaataacatcgtaaaacatgccaatgccagcgcggtgacgctccagggctggcagcaggatgagcggctgatgctggtgattgaggatgacggcagcggcctgccgccgggctctcaccagcagggcttcggcctgaccggaatgcgcgaacgcgtgtcggcgctcggcgggacgctaaccatctcttgtacccacggtacgcgggtgagcgtctcgttgccccagcgttacgtttaaggaaggataatgctttcgtttttaaaagccccggccaacgcgccgctcatcaccgataagcacgaggttgacgcccgctatcgctactggcggcggtatatcctgatcaccatttggttgggttacgcgctgttctatttcacccgtaaaagctttaacgccgccgcgccggaaatccttgccagcggtattctgacccgcagcgatatcggcctgctggcgacgctgttttacatcacctacggggtgtcgaaatttgtctccggcatcgttagcgatcgctctaacgctcgctattttatgggcatcgggctgattgcgaccggcgtagtgaatattctgttcggcttctcgacctcgctgtgggcctttgcgctgctatgggcgctgaacgcctttttccaggggtttggatcgccggtttgcgcccgtttgctgactgcctggtactcgcgtaccgagcgcggcggctggtgggcgttatggaacaccgcgcataatgtcggcggggcgctgatccctctcgttatggccgctgtcgccctgcattatggctggcgcgtcgggatgatggtggccggattgcttgccatcggggtgggcatggtcctctgctggcggctgcgcgaccgtccgcaggcgattggtttaccgccggtaggcgactggcggcacgatgcgctggaggtcgcccaacagcaagagggcgcgggactaagccgcaaagaaatcctcgctaaatatgtgctgtcgaatccctatatctggctgctttcgttgtgttatgtcttagtgtacgtggtgcgcgcggcgatcaacgactggggcaacctgtatatgtccgagacgctgggcgtggatttggtcacggccaacacggcagtatcgatgtttgagttgggtggatttatcggcgcgctggtggcgggttggggctcggacaaactcttcaacggcaaccgcggaccgatgaatttaatcttcgctgccgggattttgctctctgtgggttcgctgtggctgatgccgttcgccagctacgtcatgcaggcggcctgtttcttcaccaccggtttctttgtcttcggcccgcagatgctcattggcatggcggcggcggagtgctcgcataaagaggcggcgggcgcagccaccggctttgtcggcctgttcgcctatctcggcgcgtcgctttccggctggccgttagcgaaagtgctggagatctggcactggaccggtttttttgcggtcatcgccatcgcggcggggatctccgcgctattgctgctgccatttctgaacgcccaggccccacgcgagacccacgaagcgtgatacacctcacctttttgcgctgaatggggcaaaactaagaaattttcccggttttgcctggacgctgtcgcaggccccttttcctgtggatttttacaatgcctgccattcgcaggtataaaaattagctcaggagtaatccatgctggccttcttaaaccaggtgcgcaagccgaccctggatctgccgctcaatgtgcggcgtaaaatgtggttcaagtcgttcatgcagtcctatctggtggtttttatcggctacctgaccatgtacctgatccgcaaaaactttaacatcgcgcagaacgacatgatctctacctacaggttgagcatgaccgagctggggatgattggcctgggcttctcgatcacctacggcgtggggaaaacgctggtttcctactacgctgacggtaaaaataccaagcagtttctaccgtttatgttgatcctctccgctatctgtatgctcggcttcagcgccagcatgggcgcggggtcaaccagtctgtttctgatgatcgctttctatgccctgagcggtttcttccagagtaccggcggatcgtgcagctactcgaccatcaccaaatggactccgcgtcgtaaacgcggcacctttctcggcttctggaatatctcccacaacctcggcggcgcgggcgcggcaggcgtggcgctgttcggcgccaactacctgttcgacggtcacgtcatcggcatgtttatcttcccgtcgattatcgcgctgattgttggctttatcggtctgcgtttcggcagcgactccccggaatcttacggtctgggtaaagctgaagaactgttcggcgaagagatcagcgaagaggataaagagactgaagaaaacgaaatgaccaagtggcagatctttgttgaatatgtgttgaaaaacaaagtgatctggctgctgtgtttctccaatatcttcctgtatgtggtgcgtattggtatcgaccagtggtcaaccgtctacgccttccaggaactgaaactttctaaagaggtggcgattcagggctttaccttgtttgaagtgggcgcgctggtcggcacgttgctgtggggctggctctctgacctggcgaacggtcgtcgcgcgctggtagcctgtgtggcgctggcgttgatcatcgctaccctcggcgtctaccagcacgccagcaaccagtatgtctatctggcctcgctgttcgcgctcggtttcctggtgtttgggccgcagctattaattggtgtggcggctgtcggtttcgtaccgaaaaaagccatcggcgctgcggacggtatcaagggcaccttcgattatcttatcggcgatagctttgctaagctgggtctgggcatgattgccgacggcacccccgtttttggtctgaccggttgggcgggtaccttcgccgcgctggacgctgccgcgatcggctgtatctgcctgatggcgatggtcgccgtgatggaagagcgcaaaatccgccgtgagaaaaaaattcagcaagtcaatatcgcttaaatgtgtgcatttggtaacgttttgcccggcttaacgccgggcttttttatgccttgcgttcgtcagacaggacatccggtgtctggcgtaaatgaagacaggcgttaataaatcacatcctgacaggccagaacgtcgacagttataaatttaccgttatgatgggcatcctgtttggtgacggatgtgcgcatgatttggttgattctggccacgtttgtggtggtgtttattgtgggttttcgggtgctgacatcggatacccgccgggcgattcgccgtctgagcgaacgtctgaatattgatgtagtgccgatagaatcgatgattgatcagatgggtaaaacggcgggcggtgagtttttacagtatctgcatcgccctgatgaatcgcatttgcaaaatgccgctcaggtgttactgatctggcaaatggtgattgtcgatggcggcgatcagaatttgcagcggtggcatcgcttgctgcaaaaagcgcgtttagccgcgccgatcaccgacacacaggtacggctggcgctgggctttttgcgcgaaatggaacccgatatgcaggagatcaacgcgtttcaactgcgctataacgccttttttcagccggaagagggtgtccactggctgcattgatactcttcactatctcgttaacaaaagacgagatgaatgaggctggcaagggcggcgagccacgattaacggccggatggcacgattcatcgttagccaaataaagcgtagccgccatcgtatttgctaagggtgaaccacagaagtaacgcaccgaataaccgctaacgacgccaaaacatcagagacttatagctcatcatttctgtgacatatatcacggaaatgtgatcttgttttgaacaccaaaactgtgactccttgccatacctcctgtctcaaaatttcttatcataaactcgaagttgtacatgattgtctatagacaactctaaatgtttaggcgcgcactatgaaaacattgagtaaaagttcacacatcccactgtatcaacaggttgtggagtggataagggaaagtatttatagcggagaattggttgaggatgaccggataccttcagagtttcaaatcatggatatgctggaggtgagtcgcggtaccgttaaaaaagcggttgaccaacttgtccgggaaggtgttcttgtgcaagtgcagggtaaaggaactttcgtaaagaaggaaaatgttgcttacccactgggtgaaggtttgctctcctttgctgaagccttagccagccagaagataaacttcacaaccagcgtcataacctcccgactggaacccgctaaccgctttgtagcagagaaactgagtatcaaaccgggacaagatgttttatttcttaaacgccttcgttgtattggcgatgaaaaagtcatgttgattgaaaatcgtatcaacattgatctctgccccggtattattgatgtagattttaccagggagaatttattttcagcaatagaaagattatctgataagaaaataagtttttctgaaagccgttacgcagctaaattaattggtaatgagcgaggccattatcttgatattggtgaagacgcacctgttttgcatttggaacagttggtatttttctctagaggattggccattgattttggtaacgtctggttaaaaggtaataaatattatcttggcactattttacagcgcctggatgcctgactagcaaagaggaatctatgcaggatattcattttcgccgtcattatgttcgccacctccctaaagaggtgagtcagaatgacataatcaaggctcttgccagtccgttaattaacgatggtatggttgtatctgattttgccgatcacgtcattacgcgagaacagaattttccaacgggtctaccggttgagcctgtaggtgtcgctattccacatactgatcacaggtatgttcgccaaaacgccattagcgttggaatactggcagaacccgtcaatttcgaagatatgggcggggaaccagatcccgtacctgtcagggtggtgtttatgcttgctttaggtgaaagcaataagcagctcaacgtactgggttggattatggatgtgatctaggatgaggattttatgcagcagttactggtcatgaatgatgatgaaatttatcagtcaatttacacacgcatatctgaaagaggtgaagtatgagtaaaatgatactatttgtttgcgcaacgggtgttgctacttccacggctgtggcagaaaaagtaatggaatattgtaaagacaatgggcttgatgttaattattcccaaactaatgtagcctcattgccaaacaataccgatggtgcagctttggttgtatcaacaacgaaagttccttatgaactggatattccggttgttagtggtctgccaatcattaccggagtaggtgaagataaagttcttgaaaaaatagtttcaatccttaaaggccaagcctgatttcataaataaaaaacagataaattacccaggcgctaacgcgaggtctggtcacatctgaataagaggtcggatatgaatgatatagcacatactctctataccgttgtgcaatatgtcctgggatttggcccaacggttttattgccgctggtcctttttttcctggcattgttcttcaaagtaaaacccgctaaagcacttcgctcatcgttaattgtcggaatagggtttgtcggaatttatgccatctttgacatacttaccagcaacgtaggcccggctgcacaggcaatggttgagcgaactggtattagtcttcctgttgtcgatttaggctggccaccattggccgcaattacctggggctcaccaatcgccccctttgtcattccgctgacgatgctgattaatgtcgccatgctggccctgaataagacacgtactgttgatgtcgacatgtggaactactggcactttgccctggcgggaacgctggtttactacagcacagggagttttgttttgggtctgtccgcagccgctattgccgcgatcgtggttctcaaactggcggactggtcagcgccattagtggcaaagtacttcggtctggaaggtatttcacttccgaccctgtcatctgtcgtcttctttccaattggattgctgttcgacaaaattatcgacaagatcccgggtgttaaccgtattcatattgatccggaaaacgttcagaaaaaaatgggaatcttcggcgagcctatgatggtgggtactattctgggggtcttgttgggcatcattgccgggtatgactttaaacatatcctgttgctggggatcagcattggcggtgtcatgttcattcttccgcgtatggtacgaattttgatggaaggtttattacctctgtctgaagccattaagaaatatttgaatgccaaatatcctggccgtgatgatctctttatcggactggatatcgcggtagcagtaggtaacccagccattatctctacagcactgattctgacacccatctctgtcttcattgcattccttcttcctggcaataaagtcctgccactcggagaccttgcgaacctggcagtcatggcttccatgattgtactggcatgtcgtggcaatattttccgggctgtgataaccgcaattcctgttattatcgccgacttgtggattgcgaccaaaattgcgccatttattaccggtatggctaaagatgtcaatttcaaaatggctgaggggtcaagtggtcaggtatcaagcttccttgatggcggtaaccccttccgtttctggctgcttgaaattttcaacggaaatattattgctatcgggctgattcctgtgcttgcgctggttatttatggtgtttttcgcctgacaaaaggaacggtctatgcctgattaccacgcagcgcttgtcattgacattggtacaactaactgcaaagtcagctgctattcctgtcatgacgtgtcagttctggaagtccgcaagtttccgacgccaacaatatcgtcggacaaaggcgaggtagatttagatatcgaagcgctgtggcaggcactgcgactggtaatggctgaactggtggcttcagtaccgtttccggtaaaaaatatcagtattgcgagtttcggtgagtctggcgtctttgtggataaggagggcgtcattcttaccccgatgctggcctggtatgatcgacgtggtgaatcttatctctcgtcattaagcaaggcagaggctgaagaactgtattctataacgggattgtcacctcacagtaattactcagcatttaaaatgagatggttgcttgataactactccttgcatgaaagaaaagatatctgctggttacatgctccagaagtgttgttgtggcgaatgacaggtgcgaaaaagacggaaatatccctggccagtagaacgttgtgtctggacattgctcgccgtacctggtctcgtaatgctgccgggattctcggcataccgttcggtgtactggctccgttgataaagccgggtgaagtggctggatgggtgacggcaacgctcaggcaggagttgggattaccacatgaggtaaaagttaccctggccggacacgatcatatggtcggtgcccgcgcattacagatgcaaccgggcgatgtgctgaattctaccggcacgacagagggtattttactgctgaatacacagccaacgcttgatgtgcaggctcgcagggataagctggcaaatggttgttactccgatggtgaatttttcacgcttttcgcttctctgcctgtcggcggttatgcgcttgaatgggtgaaaaaaacctttcgtttaactgataaggaaataagcacaggcctggaaaaagtcatggagcaatacctcaaaccttcctggtctgtcgagcatgtgccggtatttattcctcatttgcggggctcgggttcgccacataaaaaccagcacattcgtggcctgctttttggtctgacggattcacttcctccggagtctctgcttgagagtgtctttatcggcctggcgatggagtttgcacactgtcacgggtgctttaatatcccggcaggcaggacagtaaaagtcattggccctgcggtgaaaaacccatactggctccagttgaaggctgacatcctccagtgtccaattgaggccattgcttttgatgaaaccgtctcccttggagcattgttgatagcctgtccgaatgttgtccccccgactgttcctgtggctgagcgatattttcctgacgcggttcgttctgcaaagttgaaaatatatcagcagcaatggctgtcattttaccaatttaaactgcggcaagaaggggcgtttattggtgaataactgtgataactcaatagttcgataatttacttatactgctcacataaatatctggagttaatatgtctttagtcaatggtaggatcctgctcaattgtattcaggaaaaacatgtccttgcgggggcatttaatacaacgaacctggagacaacaatttccattcttaatgcaatagaacgttccggattgcccaattttattcaaattgctcctactaatgcacagctttcaggttacgattacatttatgaaatagtgaagtgacatgccgataaaatggatattcctgtcagcctgcatctggatcatgggaaaactctggaagatgttaagcaggctgtccgggccggatttacctcagtaatgattgatggcgcggcgctaccgttcgaagaaaatattgcatttacccgagaagctgtcgatttctgtaaatcatttggtgttcccgtcgaagcggaattaggcgctattctgggtaaggaagatgatcatgtcagcgaggctgactgcaaaactgaacctgagaaggttcagcgctttgttgaggagacagggtgcgacatgctggcagtgtcaattggtaatgtacatggtcttgaagacatcccacgcattgatatcccgctattacaacgcatcgcgtctgtcagtccggtacctttggttattcatggaggttctggtattgacgcggatattcttcgcagctttgttaattacaaagtagccaaagtgaatattgcgagtgatttgcgcaaagcctttattactactgttggtaaggcttgggtaaataataacaacgaggctaatctggcgcgtgtcatggcgagcgcaaaacaggcagttgaggatgatgtttattctaaaattaagatgatgaataaacatcactcagcactccgcaaagtctcttaaggaaaatatatgattagacaaaaagtacgcgttatgaacagtacggggcttcatgcgcggccagccgctacacttgcgaaaattgtcaaaaaataccagtcttcattaacgctagttaataatgacaaagaaattcccattaaaggaatgatgagtattttgggggctggcgtaaagggaaacacaatgattgatttaatttgtgatggacaggatgaactggcttttatggatgaattaaaatccgcatttgctgatggctttggtgagtcagtatagtgcaattcccgtcaaacggcgcaggaagttgtagaggcttcctgcactcattatcgtatgaatagccttaacagaccatcggtaaaaccctcataccagcacctttagcccgtgtttttggacaacattaagtagtttcagtgacatcccgctgggacgcttggcgccgctttcccacttttgaaccgttgatacgctggtattcaggtaccgagcgaaaaccgactggctaacgttgagttcttctcgtaacgcttttatttcaagtggctgcaggtctttgatgctgcttaagcaggccgtgtcaaaactgcgcattgtctcctggggaatggcatccacgctaaataatccagatgccgcgctatgaatcgcttcaaaggcagggcttttgaatttagtttttgctgacatggcgcacctctaccagttctttgttattaatgagtgccgttatctgatcttcggtcaggcaagcatagtgttttgctaactcacggaaacccgcaagttcgcgatagcgaatgttggccatattctgtttggtatacaggaaggtgtaaaaccaatgttcgcctccctttgccaacacgattgcgcgatcgcggttttaattgagacgtttttataaactccgccgccaagattatctgcttttccttgcagtacggcgttgatggcctcgcttaactcgtcatcttttatcgtgtgggacttcgcttctctgttaaaccacctggttttgaagattcgcatcaggttgacatcctgtaatctaaagtatagcaccaggtgatacactatgtcttaccttttggttttacacgcagcgagagaagataattctcaacgctcgaccagcctcgcaaaatgcagcgcaacaatgtcagttgctaaaacgttaatcagatcacattttgtaatgttacactgcgtggattttccgcactaaaacgacgcaggtaaccacaatgaatgaaaatatcgcagaaaaattccgcgctgatggggttgccaggcctaactggtcagccgtttttgccgtggcgttttgtgtcgcctgcctgattaccgttgagtttttgcccgttagtctgttgacgccgatggcgcaggatctggggatctccgagggcgtcgccggtcagtcggtcaccgttacggcgtttgtcgcgatgttttccagcctgttcattacccagattattcaggcgaccgacaggcgttatatcgttattctgttcgccgttttgctgacggcttcttgtctgatggtctcctttgccaacagctttacgctgctattgctgggccgcgcctgtcttgggttggcgctgggcggattctgggcgatgtcggcgtcgctgaccatgcgactggttcccgcgcgtaccgtgccgaaagcgctgtcggtgatttttggcgcggtctccatcgcgttagtgatcgccgcgccgctgggcagttttttgggcggtattattggctggcgtaatgtctttaacgccgctgcggtgatgggcgtactgtgcgtcatctgggtggtgaaatcactgccgtcgctgccgggcgaaccttctcaccagaaacagaatatgtttagcctgttgcaacgccctggcgtgatggccgggatgatcgccatctttatgtcttttgccgggcagttcgctttctttacctatattcgcccggtctatatgaatctggcgggctttgacgttgatggtctgacgctggtgctgctaagttttggtattgccagcttcgttggcacttctttctcctcttacgtcctgaaacgttcggtaaaactggcgctggccggtgcgccgctgctactggcgctgagcgcgctgacgctcattgtgtggggaagcgacaaaaccgtggcggcggcaatagcgattatctggggactggcgtttgcgttggtgccggtgggatggtcaacgtggatcactcgttctcttgccgatcaggcggaaaaagccggttccatccaggtcgcggtgattcaactggcaaatacctgtggcgcggcggtgggcggttatgcgctcgacaatttcgggctgctttcgccgctggcgctttccggcggtctgatgctgttgacggcgttagtcgtggcggcgaaagtccgtattacgccaatgagttgatattgctgccatttgtaggccggatacgacgttagtcgttatccggcaataataaacgcttaatcaaaaccgttatgctctgcggtggcggcaaaccattctccgctttttttcaccgtgcgcgtttgggtggctaaatccagttgtacaaaaccatagcgatttttatagccgttcagccatgaccagttatcgataaaggtccacatgtggtagccaagacagtgacagccctcgctaatgcctttatgcagccatttaagatgctcagagataaagtcaatccggtaatcatcgtgaatctgtcccgcttgcacaaaacgctgctcgttctcaacgcccatcccgttttcggagataaaacagcgcggattgccgtaattatcccgcaggttggtgatgatgtcgtaaattcctggcgcgtaaatttcccagccgcggtaagggttcatcttgcgccccggcatgtcgtaatagtcaaataaccactccggcataaacggcgcttgcggattcaccgctgtatcacggcatttcacgcggcgcggctgataatagttaatccccagtaaatcgattttgccgtcggcaataagctgacggtcgcctggctgacaggcaggcagctggtcataggttttcagcagcgccaccagctccgccgggtattctccctttaataccgggtcaagaaaactgcggttgaataacagatccgcatgatgcgcggcttgcacatcggcgggatgctgcgagcgtgggtaggacggcgtcagattcagcactacgccgatttcaccgtcgtagcgcccggcgcgccaggcgcgcacggcggtcgagtgcgccagcacggtatggtacgccacggtggccgcacgtttaaaatccaccacattgggatagtggaagtcgtacaaatagccgccttccaccggcacaatcggctcgttaaaggtaaaccagtgcttcacgcggtcgccaaacaaggtaaaacacgtttgcgcgtaccgaccaaacgcctctacgacgtcgcgattttcccagccgcctttctcctgcatgaccatcggcatatcaaaatggaacagcgtaataaacggcgtgatgccctgcgccagtagctcgtcgatgacgtgattgtagaagctcaccgcttgtggattcacctcgcctacaccgtctggaatgagccgcgcccagcttagcgaggtgcgaaaactgttgtgttttaactgtttcagtagcgcgatgtcttgcttccagtggcgatagaacgttgaggtttccgctggaccgatgccctgatgaaaacgatcaggctggcgctcgaaccacacatcccacgtggtctggcttttaccaccattcagactatccccttcggtttgcaacgctgagcaggcgctgccccaccagaagttatcgggaaaacggtatcgcattgtcgtactccttgatcgcgtaaattcgctccagaatatgcgcttttggcgaacagaaaccggttacagtccgcattttcgcgaccaaaaagcggaaaagctgtgctacatctccgggcattccaccttgccgagagcctgccagtagttatgctgattgttgcgctctatcgcgatcatcgcctcccgaatatgctgctggttcccctcgcttgccatgatttttttctcccaggcttcatcggttagcgcgcctttgggcgtacacattttgcgcaaatcctttaaaatcgtatttttttcatgcgccgactggagtgagctaaacggagagtcggcatacgtgacgcccggtagcgcgacaagtgtggcaataagcagaagcgtttttcgtttcataaacggtatccttatcggtttgcactttttcaagagtaagtgtagaccgtgcgacgttcactcatcggggcgtgctatccgttggcgttgaagtcaggcaaaagtgggaaggcggtttctcgctgcgccttcactttcttgcgtggcagaatagtgtatgttctgactactcttttatttcgtaagcggtagtgtaatgagacgtattgagatcgtactgggagagctggaacggctgacgcgcgggctatgccttgccgatttggcgcaggagacggcgtttacggcggaggcgataggtttcaatcttgggctggcgcgtaactccgtcagcaaagatctcaatcagttatggaatgacggcctggcaatcaaaagccgtggccgcccggtctattttttggcatcgccaggcgctggaaacgttgctgggacgtcagctggaagagtctgaacgcgaggtgcggtcggtggcggatgtgctgccgcatgaagagcattacgcgcccgacgatccgtttaccagcctgattggttacgatcgcagcctgcgcgatgcggtagaaaaaggccgtgcggcggtgctctatccgcacggtttacacgttctgcttaccgggccgtccggcgtcggtaaaaccttttttgcggaactgatgcaccgtttcgcctgtgaacaggcgagcggcgctatcccgccgctggtctactttaactgcgcggaatacgcccataacccggaactgctctcctcgcatctgtttggtcatcggcagggggcgtttaccggcgcgaatgaacataaaacaggcctcgtggagcaggcggacggtggttatctgttgctggacgaggtgcaccgtctgtcttatgaagggcaggaaaagctgttttctattctggataaaggcgagtaccgtccgctcggcgtgagcagccagccgcgatcaatttcggtacgcctgatttgcgccactaccgaaccggtcgggtcggcgctgttacgtactttccagcggcgtattcaggtatgcattgatttgccgggcattcgccagcgctccgttgaagaacagatcgaactgatcgtggggttcttacagcgggaaagccgcaaaatagaacgcacggtcagcattgataaaccgttgttgctctggttgctgaataaacccctggaaggcaatatcggtcagctaaaaagcgatattcagtttctttgcgctcaggcgtgggcatcgggaatgaccgagcataacgacacgctacagctggataaacggctggcggagatgtcggttaacccgacgccggaacagcgtctattggtggatactctgtttgacggtaaagcgcggctaaatatagacgcgcgcacgctgcccgcattgaagacgtcgctggcgaccggggcggaaattgaagagagcgacctcttttacagcttcctgacgcgcgagtatgttaatttgcgcaacagtaacgtccccccggcggagacgctggcgatcctgaaaaataaactcagctcgatttttgaatacggtctctatagccgcgacagcgtggcgcatccgccgcgctatggcgaccagattgaagagcgcgtgacgctgctgattggctgcgtagagcaggtgttgggcttttcgctgccggaaaatctggttaacccactgcgtaaacacttcctggcgctgataggctacgtgcagcgcggcctgatcccgcagctttactcttccagtttgatcctggatcgctgcaaagacgaatatgacaacgccacgctgctgtgtcggaaaatcaacgaactgctgcatatacagtgtccggcgacggaagtggtctggctatgcctgttcctgaaagagtgccgccattatcgtcagcgtatcgatgccagccccgactgcggggtcattttgatcgctcacggcgcgaccaccgccaccagtcaggcgcaatatgtcaaccgcgtgctggagcgcgagctgttcagcgccatcgacatgccgtttgaacagtcggtgcatgacacgctggaaacgctgacccaaatgattcaaacccgccaatatcggcggcttatcctgttggtgggcatcggttcattgatccatttcggcagcaccatcagtaaattattccagatagatgttttgctcatgccgaatatcacgctgaccagtctactggaagtcgggctggatttaagctatgaaaccagcgacttaccacagttgacggcgctcctgcagagtaaaaatatcccctgccagctttgtacgccgcagcaggagaacggcggcaaagtgctggtcatctcctgtattaccggcatgggaacggcggaaaaaatcaaaaaggtgctggaggagagctttggcgaactgatgtcgcaggacaccaggatggtgatccttgattataacgaggtacgaagtctggagcgcgttcagcaggcattgaatgccagcgagcggctggcggggattgtcggcactttccagccggggctgccggatattccgtttatttcgctggaagagcttttctccgaacaagggccggaactggtgttgagcctgttaacgcccgatctgtccaacgctgaacgccgtctggagatggagcgcagcgcgatgcgctttatcagcgcgctaacgatggagagcatcatcaaccatatttctgtgcttaacccgcagcgtattctgaaagagatggagggcgtttttaaccatctgacgtcttcgctttccctgaaaccaagccgccaggtgacactgcgcttcctgatccactgctgctgtatggtagagcgtattgtgattaaccgaaaaccgttacagatggcgctggaacgtcagccgaatctggacgcgcgcgcgtttagtgtcatcaaatccgcttttctgccgatcgaagacgcgtacgccatccgtttatcggatgcggaatatttttatatctacgaactgctctatagctaatccttttactggcggggcttcgcgcctcgccagacctttcttcttcctcgcgtgacacaaattctggcacaacctttgctcttctgatgatgcgttatgccggatagcagcgtaaacgccttatccggcctaccgggagtgtcctgtcggtccggtaagcgcagtgccaccgggcaatatatgccggtgttctcatgtaattgcgccaggaggccattattttgactaccacacaaccgttgccccacatcctgctgctgacgcatggcggctggggacaaccgctttgcaacagcctgcgtatggtcacgggcgaaattaaaggcgtgacggaaatcgcgctaatgcctgtcgatacgctgggcgagttttatcaacgcgtcgaggccgtggtgaaaacgctgccggaaggctcgctgatcctgacggattttgtcggcggcacgacgtccaacgtcgcggcgcggctaagcgccgattatccggtggcggtgattgccggattgaatgcgtcgctactgctggaggcgctggacaggcgcgaacaagggatgctaaccgcctgcgtggatgagttagttgaggccgggcgcagtagctgcctggatgtggtcgcccatgtacgtcagctacaacaatcactctaaggaaaacatcatggccaatatcgttttatgccgcatcgacagccgtctcattcatggacaggttgtcacgaagtgggtcggacaatctcaggcgaaccggatagccgttgtgagtgatgaactggacgccgatccgtttatgaaaaatatctacctgatggcggcgccgccaaatatcaaagtggattgcttcggcaaccagagttttgccgctgcatggaaagaaaatcagcttggcgacggtaacgtgctggtgctttttccctcactggcggcggtgcaggacgccatacaattgggctttgacgtcacccgcattcaggttggcggtctcggcggcgggccaaaccgcaaggcggtttttcagaatattacgctggatgaaaaagacgtcggcattcttaacgacctgaaaaaccgtggcgttcaggtatttttccagaccattccggaagataagccgcagccgctcgacgatatcctgaaaaaattctaaccctttaatagacacaaaatcattctggatgcatcgaggcggcaactgagtgaatcccctggagcttactaaagtaagtgactggggtgagcgaaggcagccaacaaagaggcagcctgaaggatgaagtgtataggataacactatggataccttactctttgcaagcctgatggggttgtattactggtttgcccgtttacgcctcggctacaccttctccgcgatgctgttacaaccggtggtgatcgcggtatttgtcgggcttttgcttggcaatatgcagaccgcgatgatcatcggcgcagggatgcagctcgtttatttgggcgtgacctcaacgccgggcggcaacgtaccgtcggacccggcgctggcggcctgtatctccattcctatcgcggtgaaggccggtatggacccaaacctggcgatcgcgctggcaatcccgtttggcgtgattggcgtgtttctcgatcagctgaggcgcacgctgaacgccgcctgggtgcatatggcggataaacacgcggaaacggcaaacatggcgggcatcatgcgttgcgcctttctttacccggcattgctggggctggtgctgcgcttcccggtggtctttgccgctaactactttggccaggatgtggtggaaagtttccttaaactgatgccgcactggttaacccactcctttgaaatcatgggcggcattctgccggcgctgggctttgccatcaccattatggtgatcggtaaaaagagcctgttgccgtggtttatcggcgggttcttcgcggtgttatacctcaaggtcgacatcatggcgatggccatcttcggcacctgtgtcgccttcttgattaaaggcctggcgaaaaatgaaggagcagcatgatgagcagtgacgtaatgcaacatgaactggttgagcgcgcgcgggaaagcggggcgctgaccaaagcagatatcaccaaagcctggtttatctactggctgggcgccgaggtttccagctcctatgagcgcttacaaagcctgattttctgcgcctcgatgacgccgatcatcaaaaaactttacccacaaaaagaggagcaggtagaagcgctaaaacgccaccttaacttctttaactccgagcagaccttcggcgcggtgattcagggcatctctattgccatggaagaacaaaaaacgcgcggcgagccgattaacgactcgtctatcaccggcattaaaacgggcctgatggggccgcttgccgggatgggcgactcgattatctgggcggcggtgatgccgctgttgatagcgatctttattccgttcgcggcaaatggcagcgcgatgggcggtattatcccgctgattctctacccggcgatcaccctggcgatcagctacggtatggtccacaagggatatacactggggcgtgattcgattatcggcctgctgcaaggggggcgaatcaaagaactgatctacggggccaacgtgctgggtttgatcatgatgggcgcgctttccgccagctacgtcaaaatcaccacgccgttaaaaattagcgccttgaaaggatctgaagtggtggttcagcagatcctcgactctatcgcgccgggcttactgccactggcggcggtattcgccatctacttctatctggtaaaaaaagggccgcgctacaccaccattttgctgtcgattgtcgcactgagcatagtctgttcgttgttgggagtgctgtaaatcatgacgccgaatatctatcaacaactggggttgaaaaaggtcattaacgcctgcggcaaaatgaccattctgggcgtctcaagcgtcgcgccggaggtcatgcaggccaccgcgcgcgcggcttccgctttcgtcgagattgatgcgctggtggaaaaaaccgacgaactgatatctcgctatacgggtgctgaagatagctatatcacctcgtgcgcctcggcgggtattgccattgccgtcgctgccgctatcacccacggcgatcgggcgcgcgtcgccctgatgccggacagtaccggtatggccaatgaggtagtgatgctgcgcgggcataatgtggactacggcgcgccagtcaccaacgccattcgtcttggcggcgggcgcatagtggaagtggggtcgagcaatctggcggcccgctggcaactggaaagcgccattaacgaaaagaccgccgcgctactgtatgtgaaatcacaccattgcgtacagaaaggcatgttgagcattgacgattttgtacaggtggcgcaggccaaccacctgccgttgattgtcgatgccgcggcggaagaggatttgcgcggctgggtggtgagcggcgcggatatggttatctacagcggcgcgaaagcctttaatgcgccaacctccgggtttatcactggtaagaaaacgtggattgccgcctgcaaagcgcagcaccaggggattgccagggcaatgaaaatcggcaaggaaaacatggttgggctggtgtatgcgctggagaattaccaccagggccagacgaccgtgaccgcagcacagttacagccggtcgcggaagcgatttctgccatccatgggctttatgccgatatcgaacaggatgaggccgggcgtgcaatctggcgtattcgtgtgcgggtgaacgcatcagaattggggctgaacgcgcaggacgtcgaagcgcagttgcgcggcggcgagatagcgatttacgcccgcaaatatcagcttcatcagggggtttttagcctcgatccacgcacggtagctgaaggggaaatggcattgattgtggcgcgactcagggagattgcagaacatgcagcagattaatttttatcgtcagcgggtagcgattaacgtgctggcaaaggatatcgccaacgcgaaggctatctatgaagccgccgaaggccatgcggtcattggtgtactttccgcgcagttcgctacggtagaagagggcgtgccggaggtgaaacgctggatggcggaggtgccgtctatctcggtggggctgggcgcaggcgacccggcgcagtactacaaagcggcgatgattgccgcccatactcacccggcccatgtcaaccagacctttaccggcagcggcttcgcagcgggcgcactggcggcgacaggcggtgagcaaacacatattaacgccctggtcagcccgacgggaacgcctggcgaggtggtgatttctaccggcgtcagcagcagccagggaatgccagcccgcgtttcctgtgaagcggcggtacgcatgatgcaggatatgggcgcacatgcggcgaagtttttcccgatgggcggcgaaaagtcgttaccggaactctatgcgctggcgacaaccgccgcccgccacggcatgacgctcatcgagccgaccggcggtatctcactggataatttcggtattatcctgcaaacctgcctggaggcaggcgtgccgcgcgtcatgccgcatgtttacagctcgattatcgatccgcaaaccggcaatacgcgccccgaagacatcattcagttgatggagatagtcaaagcgctggtgtgagatttatcgccgaagagcgctacgtttacctggcctacagatgacgtgtatttgtaggcccggttagcgttacgctaccgggcgataatgcgtagcaggctgagcaaaaatgtacgtattgcagccgtcagtgattccctttcgagcctcctcgcagggttaaattttcctgaatgctgtctgtatttttggcgagtacagtggcgtcatcttattcctcaggtgacggatcgccatgaaaaaaagccccacgtccacgcctcatgatgcggtattcaaaacgtttttacgccatccggataccgcgcgggattttctcaatattcatcttccccatttgctaagaatacgttgcgatctgacgacgttgaaactggcgccggacagttttatcgagaaaaatttacgcgcgttttattccgacgtcctttggtcgctaaaaacgtgtgaaggtgacggttatatctatgtcgttatcgagcatcagagtacgccggacgcgcatatggcgttccggttaatgtgttacgcgactgccgcgatgcagcgccatctggatgctggccataaaacgttaccgctggtgattcccatgctgttttaccatggcgcgaaaagcccgtatcccttttcgctttgctggctggatgagtttggcgatcctgcactggcgcgtcagctttatgcgacggcatttccactggtagacattacggtggtgccggataacgagattatgcagcatcgacgtatcgcgatgctggaactggtacaaaagcatatacgtcagcgcgacctgatgggattggtcgagcgtttagcggtacttctgattatgggaaacgctaatgacagtcagctaaaagcgctgtttaattatttgctaatacagcatggcagcacgcctcgttttggcaagtttatccgcgaggtggcgcgttgtgttccccaacacaaggagagattaatgacgatcgtagacagaatacgtgaatcggggcgcagaaaaggtaagcgtgaaggcgtgcaacaaggcatacagcaaggtatacatcaaggtaagcaggaggaagccttgcgtattgcgcatacgatgctggaacaggggatcgagcgagagatggtgctgatgattaccgggctttctgacgaagagattaaggcaaagcgccattaaacttttccctcttccgcccggtcatcgtgattatcaacggcgttaagcggcccgcgcgcgtcgacgggaatcgagggagatcagaatcactgacgagagaatgagcagcgtgcccagccagtccggcaaggtaaaactaatccccaacagcagcagcgacagcagggcgctgcttaacggttccgcgcagcttaaaatgctggctttggggccaccaatcagctgcgcgcctttcaaatacaggctgaacgtcagcgacgtaccgatcaccaccaggtagaaaaaggccagaatcaggctgccgctcaccgcaaagtgcgttccttctttagcgtagaagggcagcagaataaggccgccaaaggacatactccagccgaccactggcagcgtgccgtattgggcgattagcctggaaggccaggtcgtataaaaggcggcggcaaatgcggaggcgataccccagaacagcgcgcctgaagagatcgacagcgatgttggattgccgtgagtcaccagtaaaaaggtgccgataagcgatgtaagaatggcggttaagaccagaatgcctggtcgtgttcttcgcgctaatgcaaaccacgcgacaataatggtcggcgataaaaattgcagcactgtcgcggtggcggcattggatttttcaatcgtgagcaggaaggttagctgaacggtgagcgcgcccaccacggagaaaatcagcagactcagtgcatctttgcggtttttaagaatcgaaaatatcttatcgccgtgcataaaggagaaggtcaccagtatcagcccggcgaataacaaacgtatcatcgtcaggaactgtgacgacatacggctttgctccatgatgtactgcgcgcaaacgcctgaactcccccacaatacggcggcaatcaggacgtttagcatcccttttctggtggaacccattttttcctcgtcatgttgttttatttttttacgtgcaggcatcataacagagctatcgccggcattaagcaggaatttattgtttaatgatttcagacgagcctgttattgacataatattgtcatttttttgtcacgggaaatatcaaacaaacttaaacaaatcgtcactatccccgcctttgcactttacagaacatattgactgactataataagcgcaaattcatgcaggagtaatatgttggacagtcacttttacgtaaatcatctggcaagttaacgcacgctattcctgcgctgcttgccgaaccggtgggcagcaatctccccttgtgacgattgtcatcccaataatgttacaacacgcgcattgtcgcgaggtaatcgtcatgttcatgtttaaacacgctttatttcctccgccgttaacacgacgctaattgcctcagggcagaaatttgtcgtgtgctaaatatagcacgtacttattcttccagaaaaaatggaggaacgtatgttaatgtttccttatattttaaatttactggccgctatgctgttgggcgcgctgattggcgcggaaagacaatggcgtcaacgtatggcgggattacgcactaatgcgctggtggcgacaggcgccgccgtttttattctgagctccatgacgacatcgccagacagccccgggagaattgcggcgcagattgtctctggtattggctttctgggggcgggcgtcatcatgcgcgaagggatgaatgtgcgcggactgaacactgcggcaacgctatggtgttcggcgggcatcggcgtgttatgcggcttagggcagttcaaaaatgcactggcggcgacgatcattattctttgtgccaatattttattgcgtgaagcggcgcagcgtataaatcaactcccggtatccgccgaggcagaaaaacgttatatcctgaaagtaacctgtaataaagaagatgagagcgcggttcgtcagtggttactgaatatcgtaaaagaggccgcgatctgtttacaagggttaggttcggtccccgctcaggaacagggctataaagaaattcgtgccgagctcgtgggtcatgctgattatcgtaaaacgcgagaactgattatatccagaataggtgataacgataatatcaccgcaattcactggagcattgatagtcaataatagttttttattcaattgcaacattacgccaggcgtataaggagggaatgatggatattcccgagtcgataaaataaaacccactcaaaatagtgagtaagcaataaccttttttatgcatagataattctcccggggcattcaccttcaaatcgtgagtttactattccctgggcgtgatatgcaggaaacactacaccttaattttggggattcatcatgactgacatgaacattgaaaaccggaaactcaatcgcccggcgtcagaaaatgataagcagcataaaaaagtatttccgatcgaagcggaagcttttcatagcccggaggagacactggcgcggctgaacagccatcgtcagggcctcacgatagaagaggccggcgaacggttgaaagtgtatgggcgcaatgaagtggcgcatgagcaagttcctccggtgctggttcagcttctgcaggcattcaataacccgtttatttacgttctgatggcactggcaggggtcagtttcatcacggattactggctcccgttacgccgtggcgaagagaccgatctcaccggcgtgctgattattctgacgatggtcagtttgagcgggttattgcgtttctggcaggagtttcgcactaacagagcagcacaggcgctgaaaaagatggtgcgcaccaccgccacgatgttgcgtcgtgggccgggcaatataggcgcggtgcaggaagagattcccattgaagaactggtgccgggcgatgtggtttttctggccgcaggcgatctggtgcccgccgacgtccgtctgctggcgtcgcgcgatctctttatcagccagttaattcttagtggtgaatcattacccgtagaaaaatacgatgttatggctgatgtggcaggtaaagacagcgagcaattgcctgacaaagataagagcctgttagatttgggcaatatctgtctgatgggaaccaatgtaaccagcggcagagcgcaagcggtcgtggtcgcgacgggaagccgtacctggttcggctcgctggcgaaatccattgtgggtacgcgtacccagacggctttcgatcgcggagtcaacagcgtgagctggctgttgatacgctttatgctgatcatggtgccggttgtcctgctgatcaatggtttcagtaagggagactgggtagaggcttcgctgttcgcgctggcggttgcggttgggttgacgccggaaatgttgcccatgatagtcagttccaacctggcaaaaggcgcgattgcgatgtcgcggcgcaaagtgatcgtcaagcgcctgaacgctattcaaaacttcggcgcgatggatgtgctgtgtacagataaaaccggcaccttaacccaggacaatatttttctggagcatcatctggatgtgagcggtgtaaaaagcagccgggtattgatgctggcctggctgaatagtagcagccagagcggcgcccggaatgtgatggatcgcgccatactgcgttttggcgaggggcgaatcgcaccatcgacaaaagcgcgcttcattaaacgcgatgaactgccattcgactttgtacgtcgccgggtatcggtcctggtggaggatgcgcagcatggagacagatgtctgatctgtaaaggcgccgttgaagagatgatgatggtagccacccatcttcgcgaaggcgatcgtgtggtggcgctgacggaaacacgccgcgagctgctgctggcgaaaaccgaagattacaatgctcagggattccgtgtattgctgatagcgacacgtaagctggatggttccgggaacaatccgacattaagtgtggaggatgagaccgaacttaccatcgaagggatgctcacttttctcgatccgccgaaagagagcgccggaaaagctattgccgcgttgcgggataacggcgtggcggtcaaagtcctcaccggcgataatccggtcgtgacggcgcgtatctgtctggaagtgggtattgatacgcacgatatcctgatcggaacccaggttgaggcgatgtcggatgccgaactggcgtctgaagtggagaaacgcgcagtattcgcccggctgacgccgttacaaaaaacgcgtattttgcaagcgctacagaaaaatggtcataccgttggttttcttggagatgggatcaacgacgcgcccgcgcttcgtgatgcggatgtgggaatttccgtcgatagcgccgccgatattgctaaagagtcatcagatattattctgctggaaaaagatctcatggtgcttgaggaaggcgttatcaaagggcgggaaacctttggcaatatcattaaatatctgaatatgaccgccagctctaatttcggcaatgttttttcggtactggtagccagcgcgtttattccgtttctgccgatgctggcgattcatctgttgatccagaatttgatgtacgatatttcgcagttgtcgttgccgtgggacaaaatggataaagagttcctgcgtaagccgcggaaatgggacgcgaaaaatattggtcgttttatgctatggattggcccaacgtcttctattttcgatatcacaacctttgcgctgatgtggtacgtttttgcggctaataacgtagaggcgcaggcgctctttcagtccggctggtttattgaggggctgctctcgcagacactggtcgtgcatatgctaaggacgcagaaaataccgtttatccaaagtcgggcgacgttgccggtattattgacgaccggcttgattatggcgataggcatttatattccattctcacctctgggcgcgatggttggactggagccgctgccgctgagctacttcccgtggttggtggcgacattattgagctactgtctggtggcgcaaggcatgaaacgcttttatatcaaacgctttggccagtggttttaataatgtttgaggatcgcccagatgaatcgctcacccgataaaatcatcgcgctgatatttttactgattagcctgttggtgttgtgtttagccctctggcaaatcgttttctaacgaggtgacgccatgcaaaaaagagggttggacaaaattttttatcaggttgtcctgatagcaatcatcctgattttactgactatctggatacgataagctgccgttggcgagccccgcttaaaataagaatcgatgtagttgttctttttatggcggggcgctattttcatggtatcccacatgagaagggcaatatcatgaataatcgtcgtggtttaaccgccgtcctggcgacgttgattacgttttccctgagcgctacgcctgtgctggcgaatccgggaaatggcaatggcggcggacatggtaataacgcggctaatcagggtaataacggtaacggacataaaggaaatgccgggcaaaaaacggaacaccgtaaaaatggcggtaaaccggatcacgtcgagtcggacattagctacgctgtcgccaggcaactggcagtgaatttagggctgacgggttatcagtctttacctccggggattgcgaaaaatctggcgagaggaaaaccgctgccgccgggaatcgctaaaaaacggtgccggcgtctatgctgggacaattaccttattatccgggctatgagtggaaaatcgttggggataatctggtgctgatcgcgctcagtaccgcggtggtcacggcgattattaatggcgtatttgattaagagcctatcccaccaggcgttattggcgcagccagtttggacacggacagcgcgcaaaaaccggagcgtacacgtagtatgtgaggtttgactcgctacgctcgcccttcgggccgccgcaagcggcgttcaaaacgctaacgcgttttggcgagcactgcccaggtccaaaatggcaagtaaaatagccccaatgggataggctctaagcgtgttgtagtccgatgacatggcgctcatctactggttgtaggctgaataaacaggcgatagataaaatagccccattaaatggggctatttagccgcttcagggcgttatttatgcgcgttgagaatccagcagttcattattttttactacttcctgcgctttggtataactttcaatcagtagctgataggccgggaatattttggtatatacatccgcccattctgcggcatcttcccgattccaggtacgttgcagctcagaggctaccgccgcggtatccattggtactacgcccgcctgcaccacgcgggccatcgtaatttcctgcgccattttactgtacgtaccggaggcatcaattaccgcaaataccttgtacccttccgcgacggcgctgatggctggaaaagccatgcagacactggtaatagtaccggcgatgatcagcgttttacggcctgtcgcttttaccgcctgtacaaaatcggcattatcccaggcattaatttcccctttacgcgcgacatattgcgcgtggggcgcattcgcatggatttccggaatcagcggaccatttggtccctgtggtacggatgcggtagtaatgaccggcatattgcataaggtagcgattttagccagcgccgcggcgcgcgcgcgtaattccggcatcggcatgtcgccgacggtctgaaacaggccactttggtggtcaatcagcagcatgactgcgtcgttagcatcaatggcagggcgttgaccgttaaaattcgcgggtgtagacataattcattccttgttgttgcctttcactgatagtcactatcagtgttaaagtcattaatcgccggggcgatttccgtttttaagctgatgacagtaatccgttgccgattctggattaccctgttgagttctttctgaaggaatattcatcggcatcaccttcagtcaatttactttcacgcgaatcggttatcacaacaatattcatattatgattaaatgtttctattttacatgtcagagaggattattgattgaaaaaacaggctatatccctacaaattgtttctgatggatagttttaaaattatttagtataagtttgaaatatatcaattaagagttaacttatttatatttaaataacataaagcacagcttaaatattaagtgggaagcgtgttgttattaagtatggctactgcaactcttaataaattggaaactatccctacataacgagtgctgcttttttggatattacaagccattatagagaacacgttcaataaaaccctgtctttcatatgatatagattttcaggatatattttctcatgatttatatatgagatattaaagcgtagtggcacagtaaatttggctacttgattaaaggtgatattctcacctcaatacaaaacaggaggcttaacgaacaagaaaaccaaacgtactttcacccctgagtctgctataatgagaaaagcggtgtctacgcttacctgttaatgtcttatgcctctcgctcttctatatgatcggtatgtgcaggggacaatccatgtcctgctacgcagccacagcatcagactatactcagtggtgtctattaaccctctccaactacgttatgttttggcatggtaacaatgcgatgttatggataattaacgataatattgaatttaatccagaaatgaatcgcctggcgtcattatcgaggccagatctcaacattattctgacaacgcccgccagccgctgcttgcgccttctgctggaaaacgccccctccgtcgtctcacaacaaacattctttcaaaaagtataggaagaagacggcatggtggtgtcggcaaatacgctttatcagaatatctccattattcgccgcggattacgtaccgttggcgaaaatgaagatacgctgataatcacggttccgcgtagaggctttcagattgagcctggtgtgagcctcatgaccatccgcaaagacttcgctcagacaatagaaaaaagggtgaggcgccaccgcgtatgtcagggcgttggtttaaacattatgtacctgtactttggatgaccgggacatttgctgtcggtattttgcttggcactatcagctggcaaaccgttcctgataaggatttttatgatcgctacacgctggttgaaacaactcagggctgtcattttttctcgcggaatgaagatatcgaaagcggtagccgctttgcaggctataagttaatgattctaaaaaccggtatggattgtcagaaatacccatgggtctatttcccttccagcagtcgcaccccagcggttacggcattgatttgtcagcaaccttataaaacgcgcggtgatacaggctgcgtgacgctttttttccgcggggtgacacatgggtaaaaaggcactgatgttagcctgcctgacgctactgtttctgggtgtagggcttgggcatctttttcatttatatacggaaaagaaccgggatccagagaaatgtacggcgcctgtgattgtgttttataacaacactcaggctaacctgacgctggactttatgtattcgctgaaaaaacgcactggagtggtttccatcagcggaacgtattacgtcgataataaaatgagcggcgtgatccgccgtgatgtttcctatgtatggagtgaaaataaagacagcacccattttatatcgacggatatcaacaaagtcacgcgtgacgaaacactgtccgatgcggttatcgagacggttttacccgatttttatgtctatccagggaaaagtatcagttacaccatcctgactcagggtcatcgtggctttatgttcaccatcgggaaacgcccgatatttttctgtacacattaagcggttttgggagccgttcatggaacgtatcagccaaatgaaagcgcttccgggtaaaagccgctgaagatcagcggctctgttgttacctgaatcagaaactgtatttaacccccagtaggccttgggtattactatagccctggtcacctacctgttgcgccacgttaccccatacgttcaggcgcggggtaatttgtccttcaatacccactttcagttcaccaatatttttcgtaccacgcatatcgctgctgacatcgtccatcttcacgctggcaggctgcgtattatggatccagttcgcttccacgaatggctggaactctcgagatttattgtcatcaatagcattgtggccgttaatataggcttttacgcccatgcgggttagcagattaccggcggtatcatccttgacgagggtaccattggcttcgcgatggtcgttagcctgcacgcccatccataccacctgcgctttgggctgcaaccagtagctttgatgcgcgctttcacctaacctgaaactgtaaccggcttcaaccgaggcggtaattcctttggatttatatttctcagcggcctgatcctgacccatgaccttgttatcaaaccagttgtacagcatccaggtatccacataagccccagaccgatcgatattgttagcataccaggtgccgtaaaggccgacgctgtaaccggtgacttgaccacgggaatgatagtcactcacggacgactgcgtgcggttctggctgttggcataacctgccattgcaccaatatgccaacggtcaagactgtcagtgctccactgtgccagatcgcctcccagttgtaacacatagctgttgatgcgggtttttagctgcccgctgccatcgttgaagcgagtatgggcgccgacgttacgcatccacaggctggtgaccttcttctcacccgtcagcatgtcggtgtactgggtttcacccagacggtcatggagacgcgtcatgaacagcgtatttgccgcatagttgttggcaagatagctgcccacttccggacggaactgatgttctgttatcggcggtgtgtcagattgtcctatgtcaggaatgaccggatcagggatgaccgggtctactggatcagggtctactggatcagggtccaccggatcgggaataacagggtcagggataaccgggtctactggatcagggtctaccggatcgggaatgacagggtcaggaataacagggtctaccggatcaggaataatcggttcgtccggctcaatgtagctggtcagataccagtttttacctttctgcaccacgttgtagtcataggctccggcaacaatacgacttgctttttcgaaagtaccgttggaattgccagcaacgttaacaatttcaataccttcaacggtttgagccccggctcctccaatattatttactgcaacaaatgtgttgcctgaagtattgccgagaacctgcagcctgtccgtttcggaatcatcatcgttgagcacagtattaaagaccagcttaccgccgttgcctacataatcttcattgatggtgagcgtttgccatggttcgccatcttcatggctgaagttaatgattgcgccactattcagcgtcaggtcagtgagcgttgagctgctggtcatattccaggtcgcatcgctcatttgtacagagataacgcctgtgcccgccgtagcgctggtgatgtacgacgccccgtcccatcgcgagttgtccgtcatattgagcttaatcgtactgttctgctgcggtagcgtaccgctggcagcggtggcgccagcagcacgaatatcaccgtcgatgacgaaacgacctcctgaagaaccgtcaacaatgccgccagtttccgtgctgatggcgtaactttcgctactgttatcgcccgccatagtaatagccgcaccgcctgccagattaatggcgcctcgggagagggcgtataaaccggcaggggctttactataggatgcagccttactggcgctgttaacgctaatagtggcattctctcccaaattaacggtagcgttagttgcatataccgcgtgtgcgctggcaccgttcaccgtaatagtagtgttgttgctaagctcggttctggaggaggatgctgcgtaaatccccgttgaggatgcgccggaggtttcgatggttgcatcgtcacccagacgaatcaacgaaccgctttgtccggtacgcagcccctccgaactgtcgccggtagtaactatatgtgcacacgattgccgacgacaatcgtatttttggcacgtgacgcatcccgcatggcgttagctgtaattccacgtccctggctaccggtcgttttgatatacagatcgtcgccgacgtaaatattggccgatccggtccaaccctggcccagtgagttatatccggcgttaataccgtcaccatcctgaccatccacgtagatgttggtacggtcaccggtaataataaataccgggttatccggagtatttgcgccgtgagtacggatgccatcgacgtctctaccattattcgcggcattcgccgactgcgtccgaatggtcaggtcgttgccaaaaatcacgcccggacttcccgtcccgctgttctgaataaccgtgacagtgtgttcaaacgcctccgcacccggcccattaagcgtgaggccattgccataaaccgggatggtgccggtgttccactgataaacgtagttgggcatggtaccgactttggtgaaaccggtactggcctgagcgggaataatagcctgtaattccggcggcagctggctgaccagcccactggatggcagactatcaacgtcaacccaggccgcctgggagggaaataccatagaggctaatgctgctgataccgctatggcgatgaatgagtaattttggggagttggcattctgcctcctgcattatggcgtaaagcgtcttccacatcgcaataatatggaaataataaaaatggaaacggatctataaaatatttgatattattttatgaatgctatgccctagcttattttcaagccgcagcttatgcacataaagtttcttaatatcaatattgtcaatatttacaatctgctgaatacttattcctgatacaaagtgcttcagtaatataaattccgtatagttaagcgttcgtccacgtttactgttggcaagccgaccggtaaacaagcggtgcatcttttgctgttgcacaatatcatcgtcatcggaataaataattccttgtattttattgcttttcaaaatccagtaattggccagcggagttaaacttctgtcagaaatcaggacaatatgcataccactgtttgccagactgtcagcccattgtaaatcggtaaatcgtcgaagattcgggaaagaaaaatcaacaaagataaaaccgctggataaatggttgtgtctatcaagcaataacttttcaataaacccttttttcaggaaagcattaccatctggccagatggaaaatgccgcattatgacagtattgcacccgtactgcgctgtcagggaataattgacaggataaatcgcaactaatgcaatggacaatttgtgaaggctttctcatcatcctgaacgactcccgtcgatgtttctattaatatttcattggtaaataaatgtgtcaatccagataatatacagtgctacggctgtcaaaagtcgcgaattattgtcagtgtcataaactcctggaaagacctaaaatacagctttaaggaaccatgacagatccgacagtcgtaatacatcatttcggattcgtatttcacccattgagatttttatacataatctccaatatcataaaaaatcttaaaacagcactatttgctaaattatgaggatgataaataacggttctcaataccatctgtctgctgccctcgtcactatcggggtgatgtgatgaaatataaaagtaaatcctgtcaacctgtaatgaattcttattattaaaacctaatttaagattttttcttttattgcattgttattcaatgacttaatggtgaaatttgtgctctcatcaacttcttatatacaaatttaagactattttatagagacgcatgtaaactttaagggggtgtaatgctaatgccatgggaaaatcttgtaacttaacgccgggagtcataccttgccaataagttgatctgacttaattctgaacgtgacagtgtgagcaaccgacagacttatcggtcgaagcaacttcagcttctggcttctcttttcaattgctcatttgatgaaaactctttcccggagcacattagtgagaaacaggatgtggtcaaacccaatgtccatagatgtcgtcagtcacttcagaaatatccgcctcctggcagatatctttaaccgctcgtccagcttcgaccaacttaattacggcgatgttctgatgctcagtgagacgggctttacgcatagagattccttcgtcagcagatcgatgacgtgatctctaaatgtgaatagcacgattatgtgggatacgtacaaaaaattaaactaactgccagtaatatgagtacttggtataagaatgtatacggatatattactactgaaatataataatgggaggggttaagaataaacaggacgtatgggagaacaagggtataaagatgaaatgcttgcagtatctaatagataacaatgaaaaatcaggtaactgagaaactattcagtgtttaggttgatgtgatattgagtcattcagccgctacagcacattatcaggataatttcgtctggataaaacggaggaatgaatcgccacaggtttaacagacaccgctgagtcatttaagatgacttaaagagagaagcccatgagcggtaaacgttatcccaaagcgtttaaaattaaagcggtaaaacaggttattgagcgcggccattctgtttccagcgtcgcaacacgtcttgatattactacccatagtctttacgcctggataaagccgccacattcacgacggcatcatgttgacctgaatctgacggggcatacaggcagttctggctggaatcgggctgtgtttatggctatcgcaagatctgtctcgatctgcgggatatcaggaacaatgcggtgtaagcaaagtctggtggttgatgcaacgtgtggggataaaggctcgggcgatcacaggaatcgtatttgaatgttaacttattgattttatgtttatattttgtattggataaatgagtaacccccataagcaccctcaaatgattttgcttgtggggtttggggacatcctgagctactttttaggctctgttttccactgtaacaaagcggcgatatctttctcaccttcggcttcttttaaacgccgttgttgctcggcaaactggctatattccgcctgcgctttttcatcggccattttcttactgactttacctgccccttgcaaaacctcacggtcgttaaattgcaggaactgatccagcttatcctgccagtcgcgtaaaaagacctgttgacgacgacgggcctgatcttcggcgaaatccagccacatgttaactacgcggttaagctcgctgacttcatcctgagtgagataattttttgccaccgtcacgtcacatttgcgcacctcttcacctttatagctggtcagccccatatgcggctggcaggcgtcagcacgctgatgaatgagttcagcggcggtatacccggtacaggcaaaatgtaacttgttctggatggtttgaaaaaactgcgtggtttctttgagggacggttgataatcggcggccagagcaaagatctcgcgtacccgcaaataaacccgacgttcgctggcgcggatatcgcggatacgctccagcatctcatcgaaatagtcgggtacagccgatgaacccacgggcggatttttcaggcgctcatcgtccatcacaaaacctttgatcaggtattcctggagcgtctgggttgcccactggcggaactgcgtgccgcgcggggagcgaacgcggtagccgacagcgagtatcaacggcaaactaaagtattgaatctgataatttttcccatcactggcagttgttcggtaaaaccgaacaactgaattttcttcaagctcgccatctgcaaagatgttctttatatgctcactgatggtggctttagctttaccgtatagttcgcagatcattccctgagagagccacagtgtattgctttcaaagcggcattcaacacgcactttcccgtcaccgctggcaaacataatgaattcacctgccggggattgggttaagtatttatcttccatgtcgcctccacttacatctgactcgtgatgctgtaatccgcttagtatgccagaaattcctggtgaagctcattacgcagatagcgtttattttggcgggtagcgcccccggatagtgtttcatcacgatatcattcatcttctccaccagatccagacgcttaaacgtgatatgcccactgcctttctgaaagtagtgcatagagaataaatcatcctcaaaaacctgctgatgcgggttatcacgaatgaagtccatcagtcggatagtcacatcgtgtcggttatcgggaatggttttaccatccagcaggaacaacatgcgctccagatccgcaatctggtcacgccgtcagccccaattcaggctgtagccccatcggtcgtgctttaccaggccgttaacgatgatccgcttaccgaagcagcagggattattggttttatagtcccagcttagccctttaaatacattgataatcccacgttcgaaaacatcctgtttattgtggtggagttgttcaaaggtgctcaggatgttggcttcgctgatggccggaagatctcctccttcgagatttttagcccactggctgcgggcttcagcgtccattaaggtcaacatcccggacttcagcatcagatcgcgccaaatgctgcggtcaatattacgggtgatcaccggcatcgctttatcaaccggttgcatcaaccagcagtcaaaggaatggcgctgtcgcatcgcccaatgctccgctacatcaccaccgatgctggaggtaagccgcgagatgtcatcaagcttatgaatcaggatttctatcaggctcagcgcagcgtcgcgccctgtgacgatgcattcaatactggtcgagcaaattagctcattatggtcagttaagacttcagcttctgtttgcatatttttggtccatataaaagcaaacgcgcctgccgggagtggcaggcgcattatgcggtgaaataaaggtgaataaatattgagggtgtaaatcaggaaggcgactcgcaataaatcatgctgtcgccctgaatcaggaatagtggtgttaaattaatgcaggggcgtggctctgtaatacctgttcagcttcttgctggaaaaactggcgtgtaatgctgaagaattcatgcagtttatgatctggcgaagggaccagatcaagctgaagtaattggtgcagatcccagtctttctcaatatgttcttcaaaaagctgttccagctcttcccaatgattacgacgctccgtttgaaggaatccgctgttcaggttcaggtgatcaatggtgtactgtgcgtactcagcttcctgctcagttaaatctattgaaggaaccacatgcccattagataaataggcaaaataacgagaacagtcagggaggtggcaatgaataaactgtgccatatccacagatttattctttccctgtacatgaccaccgaacgtgttgatgccaagctggggcaaaccattctcagagtctaacgcgctggctgcgagattttgataatcgaaggttcgccctggctgctggcttttattttcgacgtgttcaatgtgatagccgaggccacgcaaatcagcacggatttcgctgtaacagcaaagatgatattgctcattgagcagaagcgtcactaaatctgctttgtctcgtctaaagtttcgccagcgacgggtcgattgatccgaatcttgtggtggattttcatttgcagtgagtaaggcatctgtccccggcgagttttgatcacatgcctcattgtgccttccctttcagaaagttacggcatcgacaaacgtagcgcctgcgttaataaacgtaaggctatagtgccttcaagtagatgagtaagctgcgacgttactgctcgtatgaacaccatccacccttatgatgtgagcccgtacccccatgtggatgttgaccctttgggcaggcaagcgcaccggatgatgccgtgacggtaataaaagcgataatcatcgctgtaaataatctcttcatatataactcacattaataaattggaacatattactacctactacagaatacgcatacttgatacggacttaggggataatataacgtgtactttagtttaaattctatccttcatgtggcataggttatcaggataggttttcgttatgaattttatctgggatattgaagcaacatattgtgggggggatatgagttataaatatgttggtaagcatggctgtgatgttgcattgcggatgggctataaagaataccccgatgaaaatgcttatggtgatgcctattatattaaagatgggttaaaatggatatttaatataacaggcttaaaaaaacggcttggcgtatacagcgacgacgatctccgtaaacagaactatgatgtagatacctattatcgggttgaaaaccaacaggaagaaagtgcagatgatgaaatgcaatcgctatatcataatttagcggtagaagaaggagaacccgtgtatctggagggaggcatgtatctttatccggatggctctatacgttgatctcataattttggtctggtaagcgttatctcttttgagaaaggatgagtctgtaagtatgacccacaagctcgtttggtgattagttaagtcccgcccgcgttagtcctggcgtacttttatcccttctttgcggacgatatcccacaataaatggacgttcggttttagcaatcggtaaatggtgattaataaaataatattccactttctctctccacctttcctttcgtattatatgcaagaactagtcttaataataagcaaatactttgtcccgaaatagaggacgaatggtgggcatgagagaaggattttggcggaagatcacaggagtcgaacctgcccgggaccgctggcggccccaactggatttgaagtccagccgcctcaccggagacgacgatcttccgcgcctcgattgctacatggaggcgcgcgcattatagctacttcctggcgtttccacatcccctcccgtgcttttttaacttccctttccttctgccatgatcggtttcatataaacccccataaaatccattagttacatttcatcacactttttggcgctaccctgatcacagaaaacaagaatcgtaatttgataaccaaataacggaatattcacgctcgcagggaaggtttacaaaaactgtaaccggtatcagtgagcgttgtgagcgttaaggatgcgtaatgaaaagtgaaattctctccgttaaggagaagattggctatggtatgggcgatgccgccagccacatcatctttgataacgtcatgttatatatgatgttcttctataccgatattttcggcattcccgctggttttgtcggcaccatgtttttactggcgcgtgcgcttgatgccatctccgacccttgcatgggcctgttggccgaccgtacccgctctcgctggggcaaattccgaccctgggtgctgtttggcgcgttgccgtttggtatcgtttgtgtgctggcttatagcacgccggatctcagtctgaacggcaaaatgatttatgccgccatcacctacacgttgctcacccttctgtatactgtggtcaacatcccttactgcgcgttgggtggtgtaataaccaatgacccaacgcagcgtatctccctgcaatcctggcgctttgtgctggcaacggcgggcggaatgctctctaccgtactgatgatgcctctggtgaaactgattggcggcgagaataaggcgctgggcttccagggggggatcgcggcgctctcggtggtggcgttcctgatgctggcgttctgcttttttaccaccaaagagcgcgttgaagcgcctgccacccatacctccatgcgtgaagacctgcgtgatatctggcacaacgaccagtggcgcatagtcggcctgctcaccatcctgaatattctggcggtatgcgtgcgcggcggggcgatgatgtattacgtcacctggatattgggcaaaccgggcgtgtttgtcgccttcctcaccacctattgcgtcggcaacctgattggctcggcgctggcaaaaccgttgaccgactggaaatgcaaagtgagcgttttctggtggaccaacgccttactcgcagtaatcagcgtggcgatgttcttcgtaccgatgcacgccacgatcgctatgttcgtctttatcttcgtgattggcgtattgcaccagttagtcacgcctatccagtgggtgatgatgtctgacaccgtcgactacggcgaatggtgtaacggcaaacgcctgacggggatcagttttgccggcacgttgttcgtgctgaaactgggtcttgccctcggcggggcgctgattggctggatgctggcaggcggcggttacgacgcggcggcgaaaacgcaaaacagcgccacgatcagcatcatcatcgctctgttcactatcgtcccggccatctgttatctgctgagcgccgcgatcgctaaacgctactacaccctgaaaagcccgttcctgaaaaccattctggaacaactggcgcagggcgcacaccgcaacgaacaagaatttacccataaagaattgcaaaactaaaggaacagactatgaaaattagcgacggaaactggctgatccagcctggccttaatttgattcacccggttcaggtgttcgacgttgaacagcacgggaatgagatggtggtctatgccgcgccgcgcgatgtccgcgaacgaacctggcaactggataccccgttgtttaccctgcgctttttctcgccacaggaaggagtgataggtgtacggatggaacacttccagggcgctttggataacggcccacattatccgctcaatgtcttgcaagatatcaacgtggagatgcagaacaacgccgaatttgccgaactcaagagcggcagcctgagcgtgcgtgtcaccaaaggcgagctctggtcactggattttctgcgcaacggtgtacgtatcaccggtagccagttgaagaataacggctatgtgcaggataccaacagcgggcgcaactacatgttcgagcgtctggatctcggcgtgggcgaaaccgtctacgggctgggcgagcgctttaccgcgctggtgcgtaacggtcagacggtggagacctggaaccgtgacggcggcaccagcaccgagcaatcgtacaagaatatcccgttctatatcaccaaccgtggctacggtgtgctggtgaatcatccgcagtgcgtgtcgtttgaaattggctccgagaaagtctccaaagtccagttcagcgtcgagagcgagtatctggaatacttcgtcatcgacggcccgactccgaaagacgtgctgaaccgctatacccaatttacgggtcgtccggcgctgccgcccgcctggtcgtttggcctgtggctgaccacctcatttaccaccaactacgacgaagcgaccgttaaccgctttatcgacggtatggccgagcgcaatctgccgctgcatgtcttccacttcgactgtttctggatgaaggccttccagtggtgcgattttgaatgggacccggtgactttccccgatccgaaagggatgattcaccgcctgaaagcgaaagggctgaaagtctgcgtgtggattaacccctacatcggccagaaatccccggttttccaggagctgaaagagaaagggtatttacttaaacgcccggacggctccttgtggcagtgggataaatggcagccgggactggcgatttacgacttcaccaacccgcaagcctgcgaatggtatgccgacaagctgaagggcctggtggagatgggagtggactgcttcaaaactgacttcggcgaacgcattccaacggatgtgcagtggtttgatggttcagatccacagaaaatgcacaaccattatgcctacatctacaacgaactggtgtggaacgtgctgaaagagaccgtgggcgttgaagaggcggtgttgttcgcccgttccgcctcggtgggcgcgcaacagttcccggtgcactggggcggcgactgctacgccaattacgaatcgatggcggaaagcctgcgcggcgggctgtccatcggcctgtcagggtttggcttctggagccatgatattggcggattcgagaataccgcgccggcgcatgtctacaagcgttggtgcgcattcggcttgctctccagccacagccgcctgcacggtagcaaatcctaccgggttccgtgggcctatgacgacgagtcctgtgacgtggtgcgcttcttcaccgaacagaagtgccggatgatgccgtatctgtatcgggaagcggcgcgcgccaacgaagccggtacgccaatgatgcgggcgatgatgctggagtttccggacgatccggcgtgtgattatcttgatcgccagtacatgctgggagatgcggtcatggtagcgccggtatttagtgaagcgggcgacgtggagttctacctgccagaaggccgctggacgcacttgtggcgcaacgatgaagtgcagggcagccgctggcataaacagcagcatgacttcctgagcctgccagtgtacgtgcgtgacaatacactactggcgctgggcaacaatagccagaagcccgattacgcctggcatgagggtacggccttccagttattccatctggatgacggttgcgaagcggtctgcgaagtccctgctacggatggttcgacaatctttacgctgcaggcgaaacgcacaggcaataccattacggtgagcggcgaaggcgaggcgcgcaactggacgctgtgtctgcgtaatattacgcagattagcggtaccaaatgcggctcatatgcgggaagtgaactgggcgtagtggtcaccccgcagggaaatgaagtggtgattacgctttaaatctgaatcgccggatggcgccgtgagctgcgcttatccggcctacaaatgagcaagaaccgtaagcccggtaagcgccagcgccaccgggcaagccctcaattacagcgctggctccgttgacgtaacttccccgccggacaccacacccgcttgcatcgtttgcattatctgctgcttttgtgcgttgaccgcgtgtaattgcccgtttaccgtcggtttcaacggcgcatcggcctgaatattgccgctggccgtgaactgaatattgccatcgccagcaatcggtaatgccggccagccccactgttgtagcacatccattggtacgccgcgtccgttcaggctgatttgcgtctgacgctgcggctgttgtgatacgctggcagtggcttccagtatccctttttcagtaaacgcgctcagatcactgatgttgaccgtgctggcattcgccgtcaacgacagcgacgggcggcgcacgtccacacggttaaaggttgccgctgcggcgttgagggtcgcattgccgctccagacgccccattgatgatgttgtaccagctccaggtttgcgccgtagccgtccagagcggtgatttgccacgggaaggtcgggtcgatatcgatcaccagattgcggctggcgctgaattttttcagcgtcaggctgttcagccagtcgggcaacggcttcatccataactgcttccagttttccggcagcgtatactccagcccggcgatagcggtatcgtccagaatcagcgctttgctctcgcgtaaccaggcgccggaggttctgaccataccgccttcccagcgggtggtgaactggcgtagcgcaacgccctgtggtgaaaattcggcgttcaggattggatcgagcaagtgcagcgagccgtaaataaactcgctggcattcatcgataatttaccttcctgactttgccagtcttctttgcgcagagtcagattgcgcaaactcaggtcaagatcggtgactgcccagtctggtccttgcaggctggagtccgtcacttcaagacgaccaatctgcaaagatggaaccgtagtaagcggcgcgaaaaactcgctcagggatttatcgctttgtaaccggatatcattcagccgcagattttcaacgacccaactaccatcagcgttacgccgggcgacgccggttaacgctccgcgcgccatatcggcgccgacggtgtttaacatcatctgatcatggtcaatactgccttcaataagcacattcgtggcgggaacgtcgtttaacgtcagcgaaccggcgctcagttggatctgggctttattgcccaatacccgaccggcttcggggcgccagggcataacgccgccgttaacgcgctgggcgctcaaccgccattcgctgccgggactattgagcgccatattgcgaagttgcaggcggtcggcctcaaacgggaaaggggcggtttgcactgaaatattcagcgtgccgtcctgtaacagaatcgtgtcgacatgcagcggcgcggttaactggcgaatgctcagaccgatatctacggttttcgcgaccagggtagcaggctgaccatcacgaccaaaggtcacattctccagtaaaagatgggatggggcggaaaaacgatgatccatcacgtcgaatgtgaggtgatagccgctgttctctgatacccagttgctgacatgatctgcgccccagcgcgtttgcagcagaaaataaaagccgaaaatcaccactaaacaggcgatcagcacgtagagaagcaacctcccaatcaatttcatggtcttccatcccgtgaaatgcacataggggatttatgcacgatttgcgtgcaatcctcaagacaggaatggtgaaagagcgttacagcagcggcgaatcgtgtcgccgccgcagggtttttacggtttttccggcgggagaatcaggttcagcacgatagccgtgatgccgccagcggcaattccggatgagagcagatttttcacccattccggcgcgaactgcaggatctgcggctgttgcgagacgccaagacccacggccagcgacagggcgataatcagaatcgcgcggcggttcagcggctcacgcgagacaatacgcaccccggaggcggcaatggtgccgaacatcaccaacgtggcgccgccgagcaccggttccgggatatgttgcacaaaaccgcttaccgccgggaacaggccgagcacaatcagcatcagcgcgacgacaaatcccacatagcgactggcgacgccggtcaactgaatgacgccgttgttctgaccgaaacaggaattcgggaacgtattaaataccgctgaaacaaatgagttcaggccgttagccagtacgccgccctttagccgtttcatgtacaaggggccggataccggctgctcggagacatcagaggtggcggtgatgtctccgatggtctccagcgacgtaatcataaagaccagcatcaacggcagtaacaggttccagtcaatgcccagaccataatacagcggggtcggcaccatcaggatgtcctgcgagaccggcgcgttattctcaggcaacatgcccataaaccaggccaaaagatagcctgccgccatggcaataaccaaagaagccacgcgcaggtagggattacgttgccgattcagcaggatgataatggccaggacgacgccggccagtaacaggtttttcggtgcgccaaaggtgttgtcgctcatggcggcatagccgccgccgatggaagttagccccacctgaatcagcgacaggccaataatcattaccacgacgccggagactaacggcgtgataatccggcgcgccagatgtagaatgcgagaaagcaccatctcggtgcagcttgccagcatcagcgtgccgaacagcgccgccatcatcgtcgggacatccgcgccgccggttttcagcgcggtaccgcccataatcagcggggcgacaaagttaaaactggttccctggatggataacagccccgatcctaccggcccccacgctttgatttgaataatagaggctacgccggaggcgaacagcgacatgctgataatgtgctgagtatcctgcgccggtaaacccaacgcctggcagattaacagcgctggcgtaattaccgcgacaaacatggccagcagatgctgacaagcggcaaaaagggtttgagggagcggcgggcgatcttcaagacggtaaattaattcgctgttttgcgtctgcgcaaccggttgcgcatctgccggctcgatggcgttaacggacatcagggacattctcgtggtggaaaagcggtgattttatctgaccaggtggtaaaagcaaacgattgcgagcgaatattcttaatatttaaaaaagataaatgcaccttttatataactttttgcctttttctgcttaaaatccatgccgaagactcgcaaagagctaaaaaactgactcaggaaatgatttgtgcgcacatgtcacagcgcactacaggagctttaaatgtttgaactcgataccttatcgacccttgtcgccgccacgctggtgctgctactgggtcgcaagctggtccagtctgtctccttactgaagaaatatacgattccggagccggtggcgggggggctactggtcgcggttgctctgctggtgctgaaaaaaagcgtcggttgggaggtcaactttgatatgaccctgcgcgatccgttgatgctggcgtttttcgcgacgatcggccttaacgctaaccttgccagcctgcgcaaggggggacgcgttgttggcgtcttcctggtcgtcgtggtcggattactgctgatgcagaatgccatcggtatcggcatggcgagtctgttggggctggacccgttaatggggctgattgccgggtcaattacgctgtccggcggacacggtaccggcgcggcgtggagtaaactgtttgtcgaacgttatggttttgccagtgccaccgaagttgcgatggcatgtgcaacctttggcctggtgctgggcgggttgattggcggcccggtagcgcgttatctggtgaaacactccaccacgccggatggaatgcctgacgatcaggccgtgccgacagcctttgaaaagccggatgtgggtcgtatgatcacctctctggtgctaatcgaaactatcgccctgattgctatctgtctgaccgtgggcaaaatcgtagcgcagctactggcgggaacggtgcttgaactgccggtcttcgtttgtgtgctatttgttggggtgatcctcagcaatggcctggcgctggtgggtttttatcgcgtatttgagcgtgctgtttcggtgctggggaacgtgagtttgtcactgttcctagcaatggcgctgatgagcctgaagctgtgggaactggcgtcactggcgctgccgatgctggcgattctggtggtacagaccatcttcatggcgctgtacgcgatcttcgtcacctggcgcatgatggggaaaaactatgatgcggcggtgctggcggcgggtcactgtggttttggcctgggcgcaacgccgaccgccattgctaatatgcaggcgattaccgaccgttttggcccctcgcatatggcgttcctggtggtgccaatggtcggcgcgttctttatcgatatcgtcaatgcgctggtgattaagctgtacttgatgttaccgattttcgcgcaataagggtttgtacggcggcattaaagccgccgtgctcactaggcgttagaataacgttcggtttccggcatccagcgctcaatcagcgcttgtgcctgctgcggataacgttcgtgaatatgacgggcaatacgctgaacttcgggaatcatggcttgatcgcgcagcaaatcagctactttaaattcggcgttacccgtctggcgcgtgcccagtaattcccccgggccgcgaatctctaaatctttttgtgcaatcacaaagccgtcgttgctgtcgcgcaatacctgtaaacgcttctgcgccgttttcgacagcggcgatttatagagcagcacgcagtgcgatgcgaccgcgccacggccaacgcgccctctgagctggtgtaattgcgccaggcccagccgctccgggttttcaataatcatcaggctggcgttaggaacatcgacccccacctcaatcaccgttgtggcgaccagcagatgcagttcaccctgcttaaaggcctgcatcaccgcctgtttttcggcgggcttcatgcggccgtgtaccaggccgatattcaactccggtaacgccagcttgagctcctcccaggtggcttccgccgcctgcgcttccagcaggtcggactcttcaatcagcgtacagacccagtaggcctgacggccttcggttgtgcaggcgttgcgcacacgatcaatgatttcatggcgacgggtatccggaatcgcaacggtagtgacaggggtacggcccggcggtagctcgtcaatcaccgaggtatcgagatcggcgtaggcagtcatcgccagggtgcgcggtatgggcgttgcggtcataatcaactgatgcggatgaaagccctgctgctggcctttttcccacaatgccagccgctggtggacgccaaagcggtgctgctcatcgataatgaccagcgccaggccgttgaactgcacctgttcctgaaagatagcgtgggtgccgacaatcatctgcacctgaccgctggcaatagcctcttgctgcgcctgacgcgctttacctttttgcttacccgccagccaacccacttcaacgcccaacggttcgaaccagttgcggaaattatttgcgtgctgttcagccagcagttcggtcggtgccatcaacgcgacctgcttaccgtgggcaatagcgcgcaaggcggcaagcgccgcaaccagcgttttccctgagccgacgtcgccctgaaccagacgcatcatcggcacatccagcgccatatcacgttcgatctctgctaccacccgcgcctgcgcgctggtgggtttaaacggcaacgacgccagcagcttgtctttcaatatgttgttggtacttagcggctgagtgtggtagcgctgcgcgcctgcgcgaagcgccagcatactgaggttatgcgccagtagctcttcaagaataagccgccgctgagccgggtgtttgccggtttctaaatcggcgagctggagtgtcggcggcgggcgatgcaaggtacgtagcgcttccggcaggctcatcataccctgcgccagttccggcggcagtagttcggcaatggcgcaggtgtcgagcaactccagcgcctgatcggtaagcttgcgcagtgtcgcttgcttcacgccctcggtggtcggatagacgggggtgagcgtttcctgaagttccggcgtgctgagatcgccctgcaggcgatattccggatggatcatctctgcgccatacttgccgcgcttcgcttccccgtaggccagcacacgccgccccgtcgccaggctgtttttcatcgccgcgttaaaattgaaaaagcgcatggtaagaatgccggaaccgtcgctaatctggcaggtcatcatccggcgaccgccgaaagtgatattgcagttcagcacttcaccttcaacggtggcgtagatgccaggcagcagttcgccaatggggtagagatgggtacggtcttcgtaacgcagaggaagatgtaatagtaaatcctggacggtatgcaggccaattttcgccagtttactgctttgcgctgcgccgacgcctgtcagggaattgagcggaacagcgtctaacaagcggcctgacatggtgattaccctgccgcctgcatcgtcgcccaccagtcagcatcggcgtcgatttcgccctgctgattgacgcgaggataaggcagacctttacgtttagcgactttcgccagcaccggataaccaccctcaaacagcaggcgctgctgttcatcttccggcaacatgctattttcacgcagatacatgcccgcgttctgtcgctggcgctgggcttcataaagaatgagcgcggaggcgacggaaacgttcagcgactgtaccatgccgatcatcggaatgatgatgtcccgatccgccaggtctaatgcttcctgagtaataccggttttctcctgacccatcagaatacaggtcgggcgcgtgtaatcaatctcgcgaaagtctacggccttatcagaaagatgggtggccagaatctgcattccccgtcctttcaaatgggctaccgcatcgtcaatggtacggtgagttttcacctgtacccaactgttgctgcccgccgccgcggaagccatggtgcgcatccggctaccaggccagatggcatggacttcatggacgccaacggcatctgcggtacgaatgattgcagaaacgttatgaggtttgtggacttgctccatgcagaccgtgagatcaggctgacgcctggcgagcatttcgcatatacgcgcataacgttttggattcatagcgctagtttcggttacgggtgactttaataacgtctggcatcacgcggattttgcgcatgatattcgccagatgtacgcgatcgcgtgcggtaaggcgaataaaggtactatagacgcgaccatctttttcttcagtattcaggctttgaatattggaggtggtggtattaatcgccgccgtcaggttagccagcgcgccctgatggttaaacatttccaccttgatttcggtaatgaattcctgctccgtctctttgtcccattcgaccgccataaatttctctggctctttctggtatccacggatattacggcaggattcatggtggatcaccagtcctttacctgggctgacgtgagcgatgatcgggtcgcctgggatcggacgacaacacttcgcaaaggtgataagcacgccatccgcgcctttaatcggcaggtggccgtgattcgattgcgcaacggtcggcaccacggcttcgccttgctgcagatttttcgcgaccactacgctcatcgcgttgccgagaccgatttccgccagcagatcgtcaagcgttgccagcttcatacgatccaattcgcgctgaatattttcctgcggaatttccgccagcttacgactgccgcctaaagcatggttaagcagacgacggcccaggcttacggagtcatcacgtttgaggtttttcagcaactgacgaattttagcgcgcgctttagagctgacgacaaagttcagccaggcggcgttgggacgcgcgcccggcgcggtaataatttcgacggtctgaccgctgctaagcggctgtgacagcggataaggctgccggtcgacacgcgcgccgacgcaggcgtggccgatgtcggtatgcactgcataggcaaaatccaccggcgtagcgccagcgggcagttcgacaatgcgcccttccggggtgaaaacgtaaatctcatccgggaagagatcggattttacgctttcgataaattcaaacgaactaccggcgctctgttgtagctccagcaggctctgcatccagcgctgggcgcggatctgcgccgtggtgctggtctcaccgtgctctttatacgcccagtgcgccgcaacccccatttccgccatctgatccatgtcttcggtacggatctggacttcaacaggaacgccgtgcgggccgatcatcgaggtgtgcaaagactgatagccgttcgctttgggaatggcgatatagtctttcacgcgtcccggacgcggcttatagagactgtgcatctggccgagtacgcgatagcaggtatcggagtcatgaacgatcacgcggaaagcgtaaatgtccatgatcgagtgaaaacgctgctctttgagcaccattttgcagtagatcgagtaaagatgtttttcgcgaccgctaacgcgacacggaattcccgcctcttgcaaacgtccttcgatttcagagaggattttttggatcatctctttacggttgccgcgcgccgctcttaccacttctttaatgacgcggtaacgattgggatacagcgcttcaaaacccagctcttccagctcggttttaatatgatgaatacctaaacggtgcgccagcgggctgtagatttcgagggtttcacgggcaatacgacgacgtttatccgggcgtaacgagcccagcgtgcgcatgttatgggtacggtcagcaagcttaatgaggatgacgcggatatcctgcaccatcgccataatcattttgcgaaagttttcggcctgcgcctctttcttatcgcggaacttgagcttatcaagtttcgacaccccctctaccagctcggcaacgcttttaccgaaaagctgttccatgtcctgataggtggcgggggtatcttcaatcacgtcatgcagcagagcggccatcagcgtttcgtagtcgagtttcatctcggccagaatacaggccaccgctaccgggtgcgtgatatagggttcaccgcttgaacgtgtctggccctcgtgagcgtcacgtgcaacgagatacgcctgccgaagacgcttaatctggtcttccggcaggtaggtttgaatcagttgattcaggctttcaaacagatacaagggcgacccgctttgtgattaacgacgaccttcagcaatagcggtaacggcttgtaattcagcggcttcctgctcttgctgttcctggcgctcgcggacgtcgaggatctggttgttaatcagaccttcttcgatttcgcgcagcgcgataacggtagttttatcgttttcttccggtaccagcggatcctttccgcctacctgcatctgacgagcgcgacgcgcggcgaccagtaccaggtcaaaacggttaccaattttctctacagcgtcctgaacagttacgcgtgccatacttaaaatgctccacaggtgaagaaatgactgggcatgatactgaaagtgggttcagtctgccaacaatttgctgattaaagcgtcatgacgctgcttttggcggctcatacgcagacgttcagcgcgaatgatggttttcaagtcgcttaacgcggtatcaaagtcgtcattcacaataagataatcatattcggcgtaatggctcatttctgcaaccgcttgcgccattcgtttggcaatgacttcttcgctatcttgcccgcggccgcgtaaacggcgatccaattcgatctttgatggcggcaaaataaaaatgctgcgtgcttgcggcatcttttcgcgaatttgctgggcgccctgccagtcgatatccagaaaaacatcaacgccagttgccagcacttgctcaatggtttcgcgcgaagtgccgtagtaattgccaaacacttccgcgtgctccagaaacgcctccctgccaatcatggttttaaactcatcatgatttacaaagaaatagtgctcaccgtgcacttcacccggacgcggcgcgcgcgtggtatgtgaaacggaaacctgagtgtcgtacaacggttgggtttttaataaagcctgaatcaggctggatttacccgcgccactgggggcagaaacaatataaagcgtaccttgagccatgagtatcttacgtctgtgattatcgaaatagagccttgatacgggcttattatacacatcgccgttatgcgacgtagtctttgtcacactttttgcgccagattattgcattttgcgtccctttttccgcttttatcgcgtcgttgcagcaacccaccaaaaaatctggaaagcggctcggatggtgcatttttacctgtcggtttttattcactaaagcgctatacctgccgggcaatgtgcgcaggaggttgtgatgagattatggaaaagtatggcgtggggaattttattgtggcattcgcagagtggggcgctttgcccggcctggccgccagcaagggccgctgaagaaatcacccgtttacagcaacagctcgctgactggaatgacatctactggaaacaaggtgttagcgcggttgacgatagtgtgtacgaccaactcagcgcaaggctggttcagtggcaacgctgtgttggtcaggatgtttcatctactccggtttcaccgccgttaaacggtacaacaatgcaccctgttgcgcacacgggcgtacgtaaactcgcggaccgacaggcgtagaacagtggatgcgcgggcgcagcgagctttgggtacagccaaaagtggatggcgtagcggtaacgctggtttatcaaaacggtaaactgaccagggccattagccggggtaacggactacaaggcgaggactggacgccaaaaattcgcctgatcccctctataccgcagacaacacaaggcgcgctagctaacgcggtgttgcagggcgaaatctttctacagcgcgagggacatatccagcaacggatgggcgggatgaatgcgcgctcgaaagccgcaggaatgttaatgcgccaggataacgcctccgcgctaaattcgttgggtatttttatttgggcgtggccggacggtccggcaaatatgcccgaaagattaagccaacttgctaaggctggattcagtctgacgaagaaatattctctggcggtaaaagatgccagcgaggtcgagcgggcgcgccagtcatggctgacgtcagcattaccctttgtgacggatggcgtagtgatacgcatggctaaagaacccgcgtcacaatactggcgacccgggcagggcgactggctggcagcatggaaatatccgccagtagcgcaggtcgcgcaagtgagcgctattcagttctcggtggggaaaagcggcaagattaccgtagtagcgtcgcttgtccccgttatattggatgataagcgggttcagcgggtcaatatcggttctgtgaagcgttgggaagcgtgggatattgcgccgggcgatcagatcctggtgagtctggccgggcaaggcattcctcggcttgatgaggtcgtctggcggagtcgtgagcggagtaagcctgtgccgccaggtagccatttcaactcgctgacctgcttttacgcgtcggcaacgtgtcaggaacagtttatctccaggctggtatggctggggtcacggtcggcgttgggtctggacggaatgggtgaagctagctggcgggctttgcatcagacgcatcgctttgagcatatcttctcctggcttgccctgacgtcagcgcaaatagccaacacgccaggcgttgctaaaggaaaaagcgagcagatatggcggcaatttaacctggcgcgccggcagtcatttacccgctggatcatggcgatggatatccccttaacgcaggccgcattacaggccagcggtgatcgctcatgggagcagttattaatgcgaacagagcaacactggcggcaattgccagcgacgggcgagcgccgtgccgggagagttatcgactggcggaataatccgcagatcaacgcgctgagcagatggctggctactcagcatattcccggatttgggtcttagtgtccttcatgacggtaataaaataccggcaggccaagtttaagacgtagcgctaataaccttgctgtaaagccaaacagtagcgtagagataacgacgacatccggattcatgacgtaatgttgtagcgcaatatagagcaccgccgaggcgaacgaaatgccggcatacagctctttttgaaacaccagtggaatgcgtttgcagaacatatcgcggagcacgccgccaaagacgccggtagtggcggcggctaccacggcgataattggcccttcgcccatatcaagggctatctgagcgccaataatagagaaaaccaccaaccccagcgcgtcaagtaccaggaaaagcttgcgtaaatagggcatgacgggagcaacaatggtggtcaatacggcggcagtcgccacaataatgacatattcgggatgcttcacccaacccagcggatagtgaccgagcagaatgtcgcgaaccgagcctccaccaatggcggtggcggtagcaataataattacgccgaatgtatccatgcgacgacgacccgcagcgagtgcgcccgtcatggcctcggcagtgatgccaattaaataaagaacgtgcaacagcatgatttccccctaatttactgggggcgaagattaacgatttgtgcgctgtatcacgattgagattttctaaggcattacacgattaataaattttagtaatgattctaaatttatgattaataattatttattataaatatcaataaattgaacatcatttttgtggtttattgtatacgaggtttttctgttttgacttagataaattacctgaacggcgccctggacgcgccgccggtgagtcatttcattgtggctgctgtgcggtaagttgtgtgatgaagcgctgacgcgagcgttccacatactgttgcaagccattggaatcaaagaatgcctgtgtatcgccgttgcgaagttgctgtcgtttctccagtagcccgaagcggtcacctttgttggcaataaagatatcaacatgctgggcggccagtgttttaaagctgctctgaatatcagtaaccaggtcagggtaatttttgttgttaatcagcagatagtcaggtgtggcgagactatctgcgtaaattagcgtcttgccgttgcggagcgttacgcgccaggaggttgagccgggcagatgtccaggcgtgaatagtgctgtcacggttacccctccgaggctgatgctttcctggttgtggataattttatcagtggtgacgagcgggaaggggagcgcatcgccaagcgcaaaatcctgtcgtccacccctcgccatctgatcggcgttgggttgactggcgaccaattgtgcgccgctccacgctttcaaacgtgccatgccccccgcttgatccagccgcgcatggctgctcaacagatagcgcacgtcagtgaagcgaaatcctgccgcttcaatattcgctttaatttgcggtgcgctttcatccagccccgcatcaataagaatatgccctgccggagtggtcagcagaatagaagagagattttccgtaccgacataccacacgccttctgtgatttgaaacggcttcataggcttagcccacgctttaaacagtgataacggaggcgcgggtgataacggttgtgaaggatctaatgccgccatggcaggaagtgctgatgttgaaaatatacatacaaagaataatacatagcgattcataatgttctcctgattgaagcgcccgcagtatacctggcagtaatttagtcaggttcaataagagagacgtttaatgaacttgctgcaaatggatatgaacctgttaaaagtactgtatgtgctgctggagacgagctctacggggaaaacggcgcaaaagctggctttgtcgccttctgcggtgagtcatgcgctaatgagattgcgcgatgcgctaaacgatccgttgtttcgacgggaggggaaccgccagattgctacgccttatgcgcaggcgctgcgtgacaagttggcgcctgtgtttgtttcgcttaatgaggagctgtttggcgataaagagaacggctcccgttgtttccgggtggtacttcctcccgcattgaacgcgctgcttacgcccgttctcgcagagaaaggtcatcttcatcaggcggtgatcgagtgccttccttttgcccgccgaccctggcgtgatgaactgttggatagctcggttgatttggtgctggcaattggcgaccatcaaaagcaggtcagcgctctgcattacgagcgggtggggacgacgcgtttgatcgcggtttatggcgcgccattgcgttcacgtctggagaatgccgcagcgttgaattttgctgatctgcagcattatcaacacatttactgtttgccgtggacaaaagagaacaacgaactggacaggcagcaggctcgtgccgggtttgaacgtccgttggcgtttgtttgtcatgattacagtcaacttgcgcctgctgtccagtcggcgccgctaatggcgattgtaccgcgcccctggtatgaaaatttatccgataagcgcggtctttttgtcctgccgcttgccggggagcaggcggaaggcgctatttttatgcagtatcgggcttcgacggtagagtggaagcgacgccttatcgacgctattcgccggaaattaaaaacgtactaccgataaacgcgagagcccgcataaggcggactctgtgacatattgagcgccagaattattcaatattctggatctgctcgcgcatttgctcgatcaacacttttaattcaatagcggagttagttacatcagcgttgatggatttagaggccagggtgttcgactcacggttaaattcttgcatcatgaagtccagacggcgacctaccgcctcttttttcttcagaatgttgtaagtctctttgacgtgcgcttcgagacgatccagctcttccgccacatcaatgcgctgcgccatcatcaccagctcttgctccagacggttgttttccaactgaacctgagcatcttccagcttcgcgaccaggcgttcacgctgccattgcaggatttccggcatatgcgcgcggactttcgctacttcggcgctgacgccttccagacgttgttcaatcagcgctttcagcgcctggccttccgtttcgcgcgcgacgataaagtcatccagcgtaccgtccagtgcggctaaaatttctgcggcaatcgcgtccagatcctgctcttgcgccgccatgacacctggccagcgcaaaatatcaaccggattgatttccccttcgtcgctctgcattttgacccagtttgcggcgctaactaattgtttcgcgagcttttcattcagaataagctcgccttgcgcgctggcatcgggttcaaaacgcagcatacattcgactttgccgcgcgtcaggcgtgtacgaatgcgttcgcgcacgacgggttcaagactacggaactgttccggcagacgaaagtaagtttccagataacgctggtttaccgagcgcatttcccaggtcgcgctaccccattcacccttgatttcacgccgggcgtaggcggtcatactgcggatcatagatgttcccgtttttaaaggagagatgaggggattatagctatccatgccttgtcaggataggaataaccatcggaagtccgtataatgcgcagccacattcgttttaagccggagatctcaatatgcgtccagcaggccgtagcgctaatcaggtgcgtcccgtaaccctgacccgtaactatacaaaacacgctgaaggctcggtactggtcgaatttggagataccaaagtgttgtgcactgcctccattgaagaaggcgttccacgttttctgaaaggacaaggccaggggtggatcaccgcagagtatggcatgttacctcgcgctacccatacccgtaatgcgcgcgaagcggcaaagggtaagcagggcggtcgtactatggaaattcagcgtttgatcgcgcgtgcgctgcgtgcggcggtcgatctgaaaacgctcggcgaatttaccattacgctggactgcgatgtaatccaggcagatggcggtacgcgtacagcgtctattaccggtgcctgcgtggcgttggcggatgcgctgaataaattggttgccaacggtaagctgaaaaccaatccgatgaaaggcatggtggcggcggtttccgtaggcatcgttaacggcgaagcgatctgcgatctggaatatgttgaagattccgccgcagaaaccgacatgaacgtcgtgatgactgaagacggccgcattattgaagttcagggtaccgcggaaggcgagccgttcagccatgaagaacttctcactttgttggcgctggcccgagggggaattgaatccattgtggcgacgcagaaggcggcgttagaaaattgattttaaggcgactgaaaagtcgccttttttttgtccgtaaatttcgtaaatgatgaaagtaagaaaaggagcgaatccatgaaaccgtatcagcgccagtttattgagtttgcgcttaacaagcaggtactaaagtttggcgagtttacgctgaaatccgggcgcaaaagcccctatttcttcaacgccgggctgtttaataccgggcgcgacctggcgttgttaggccgtttttatgccgaagcgctggtggattccggtattgaatttgatctgctgtttggccccgcgtacaaaggtattccgatcgcgacgacgacggcggttgcgctggcggaacatcacgataaagacctgccgtactgctttaaccgcaaagaggcaaaagatcatggcgaaggcgggagtctggtgggcagcgcgctacagggccgcgtgatgctggtggatgacgtgattaccgcaggtacggcgattcgcgagtcgatggagattattcaggcgcacagggctacactggctggcgtactgatttcgctggatcgtcaggaacgtggccgcggcgagatttccgcgattcaggaagtggagcgcgactatggttgtaaggttatctccatcattacgctgaaagacctgattgcctatctggaagaaaaacctgatatggctgagcatctggcggctgtgcgagcataccgggaagaatttggcgtgtaagcgaattgcccggtggcgctttaccgggcctatatttctgtcgcctggataaggcgtgagccactatccagtcagcgttactgcaactgcgcggcaatgagcggccagcgggcgtcgaaatcgtccgttgggcggtatttaaattcgctacgcacgaaccgtgaaagcataccttcacagaaggctaacagctggcttgccagcagatttttatccgtcgtgtagccttcgccttcacgcattcttttttctcgtagcacctggcggagctgcgcttcgatgcgttcaaaaagctgattaatgcgcccctgcaggcgatcctgttcaaacatcagcgcatgcccggtaagaatgcgcgtcaggccagggttgcgttcgccaaaacccagaatcagtaacacaatcaggcgcaaacgcgtgctggtgtctttttcatcttttaaaatcagattgatacgggtaatcagactatcttcgataaactcaatcaggctatcgaacatgcgggtcttgctgggaaaatggcggtatagcgccgcttcggaaacgccgaccgaggccgccagttttgccgtcgtgatgcgttggcttccatcgctggattcaagcatcagcgccagtgactgaagtatttcttcgcgacgattccttttcgcagtttgtttttctgccatgttacaaaatacccctgaaaataagcacttgccaggcgagcacccacgctataaccgcaaactcagcgcttgcggcagtattatgacgttatggggatgcgtaaaatttacttacggccagaatgaccgaagccgccctcgccacgttcggtggcgtcaaatgcttccaccagattaaattcggcctgaacgaccggaacaaacaccatttgcgcgatacgttcgcccggttcaatggtaaaactgtcctgaccacggttccagatcgaaaccatcagttgcccctgataatcggaatcaatcagcccgaccaggttgcccagcacgataccatgtttatggcccaggccagaacgcggcaacatgactgccgccaatgatggatcggcgatatgaatggccagtccggtaggcaccaacgtcgttgcgccaggcgccagttctacggcgtcgtcgagacaggcgcgcaggtcaagcccggcagaaccagaagtagcataagtcggcagcggaaactgctgaccaacacgcgggtccagaatcttaacgtcgatttttttcatcataacgggtcacgatctcgtcgagtaataattggcccaggagttcttttcgctcaagcggtaagactttatctccatcctgccagaaaaggtgtaaagcgtttttatcgctattaaatccctgatttgaaagagaaacatcatttgcacaaatcaggtcaaggttcttacgggtacgtttttgccgggcgtattcttccacattattcgtttccgcggcaaacccaacaacgtaggggcgattgtcactgagtgcggccaccccggcgacaatgtccgggtttttgaccatttttattattaattcatcactttgcgccgcctgttttttgattttttcactggcaatagtctctgcgcgatagtcagccacggcggcgcagctaatgaaaatatgctgctgttgaacggcggcctgaacagcggcttccatgtccagcgcggttatgacatcaacccgttttacaaaaggcggcatcggtaacgaaacgggaccggagaccagcgtgacatttgcgccgcgacgcgctgcggccgccgcaatagcgaagcccattttaccggagctgtagttggaaatataacgcaccgggtcgagcggttcgcgcgtcgggcctgccgtaatcatgatattaagatgtcgcagatcgttgacggcagcgaaatgcgcggcggccttatcaacgatagctaatgggtccagcattcggcctgggcctacatcgccgcacgcctgactgccgctatccggcccccaaatgaacaggccgcgagaggcgagcacctccagattatgttgcgtggcggcagcgcggtacatctgttggttcatggccggaagaacggccaccggggctggcgtcgccaggcagatggtggagactaaatcattagccatacccgatgctacacgggcgatcagatcggcggtcgcgggggcaagaatcaccaggtcggcccatttccccaactcgatatgccccatcgcagcttcggcggcagggtcaagcagactgtcggatacgggatagcccgacacggcctgtaagctcaggggggtaataaaggcttttgccgcctcggtcattgccacgcgcacgtcagcgccgcgctcacgtaaacggcgcaccagctccggcgttttatacgcagcgataccgccgctaacgccgagaacaatttttttaccggccaggctcatcatgtctttcctgttgggtgactttgaaaggcggctattttatcacaatctctacggcgtcgtgtctttgcctgcgctccactttgcgaggcgctacgcaagaacaaaatcggggcgtcgatctctcccaaaggctgtgccactatgccgcttccttaaaaaaggaggtgcgcgtatggatacgttggacgaattattgccgcgtgaaaaaatgctcagatccggcattgcttccctcagcgacgtggaactgctggcgctttttttacgtaccggcacgccgggaaaagatgttatgacgttggcaaaagagatattgcagcactttgggtcgctgtatggcctgctgtcggcggactttgcgcagtttcgcggcgtaaacggcatcggcctggcgaaattcgcgcagttgaaaggcattgctgagctggcaaggcgctattacagcgtgcgcatgaatgaggaaagtgcgttgctgagtccggaaatgacgcgggaatttctgcaaagccaactgacgggcgaagagcgtgagatctttctggtgatcttcctagatgcccagcaccgggtgcttcagcacagccgcctgttttccggcacgcttaaccacgtagaggtgcatccgcgtgagattgttcgggaagcgattaaactcaatgcttcagcggtcattctggcgcataatcacccttcaggctgcgcagagccaagtaaagcagataaacttatcactgagcgcgtgataaagtgttgccagtttatggatatccgggtgctcgatcacctgataattgggcgcggagagtacgtttcttttgccgaacgcggctggatttaagattctttgcgcgatccatcgggatctttgtctgttcgggacttgagcatatcgccgggtcagcgtatactacgccacctttgagaatctcgggtttggcatttgggcctggcaatcgagagttcaatagaactgcgcgatgaccaggctgtaaagcctgacgaggcgccgataccccatacgaagctcgagctaatttgatttttggagaatagacatgtcccgagtctgccaagttactggcaagcgtccggtgaccggtaacaaccgttcccacgcactgaacgcgactaaacgccgtttcctgcctaacctgcactctcaccgtttctgggttgagagcgagaagcgttttgtcaccctgcgtgtatctgctaaaggtatgcgtatcatcgataaaaaaggcatcgaaacagttctgtctgaactgcgtgcccgtggcgaaaagtactaagtactaagaggaaataaatcatggctaaaggtattcgtgagaaaatcaagctggtttcttctgctggtactggtcacttctataccactacgaagaacaaacgtactaagccggaaaaactggaactgaaaaaattcgatccagttgtccgtcagcacgtgatctacaaagaagcgaaaatcaaataattctcgctttgatgtaacaaaaacctcgcttcggcggggttttttgttttctggccgtccccatattaatgagacctgccacacagccggagacgttatgcctgaattacccgaagttgaaaccagccgccggggtattgaacctcatttagttggcgctactatcctgcacgcccatatccgtaacggtcgtctgcgctggccggtttcagacgaaatttatcgtctgagcgacacacccgtccttagcgttcagcgtcgtgctaaatatctactgctggagttgcctgacggctggataattattcacctggggatgtcgggaagcttgcggatactgtcggaagcgctgccggcggaaaagcacgaccatgtcgatttggtgatgagcaatggcaaaattctacgttataccgatcctcgccgctttggcgcctggttatggaccaaagagctggaaggacataacgtactggcgcatctgggaccggagccgctaagcgatgagtttaatggcgaatatttgcaacagaaatgcgcgaagaagaagacggcgattaaaccctggctgatggataacaagctggtggtcggcgtggggaatatctacgccagcgagtcgctgtttgccgctggtattcaccctgaccgcctggcgtcgtcactctcgacagaggagtgcgacctgctggcgcgggtgattaaagccgttttgctgcgctctattgaacaaggcgggacaacgctgaaggattttctgcaaagcgatgggaagccgggctattttgcccaggagttgcaggtgtacgggcgcaaaggcgagccgtgtcgggtatgcggtacgccgatagtcgcaacgaaacacgcacagcgcgcgacgttctattgccgtcactgtcagaagtaaaatgccaggcccggcaaggaaggaaacttatttcaacttatccattagcgcctgatgcacattgtcgggcagaaagtgggtcacatcgccctgatggcgcgccacttctttgaccagcgacgatgaaataaacgaccactctttggacggcatcaggaaaacgctttccagttgcggcatcagatggcgattcatatgcgccaactgcatttcatattcaaaatccgccaccgcgcgcagaccacgaatcaggatattcgcctgtctgtcgcgggcgaaattggccatcaggtcgctaaaacccaccacctctacgttacccaggtgtgcggtcgctttttgcgccagcgccacacgttcgttcagggtgaacatgggtttcttgccggggctggcggcgatggccagaatgacatggtcgaacatctgcgttgcgcgcgtcacaatatcgagatgaccgttagtaatcggatcaaacgtgcctggataaatcgcccgtttttgcatgacagccctcaatgcgttttcggtggcagataaggttccagcagttgcagcagacgctggagcgcgccctgattttgatacagcacttcaactgcgtgacgtccgtagaaattacgataatcagcgtcggtcagtaaagaggaaacttcttttgccagcgtagccgcatcggtaatcgtgataagcccgctcgcctgctccagacgggcgcaaatatctttaaagttaaaggtatgcggacccatcagtaccggaatcgcatgagcggcggcttccagcgggttgtgaccgccgcgttcaaccagcgaaccaccaacaaaggcgagatcggcaatgccatagagcaacattaattcgcccatggtatcgcctaccacgacctgggtgctggcggacggcacttcgcccgaagagcgagtgatgtagcttaaccctgcctgacgcacaagattgatagcatccgggaaacgctccggatggcggggcaccagaatcagtaataaattcgggaattgatgtaataacgcctggtgagcggcgataacgatactctcttcgccatcgtgggtgctggtggcaatccagaccggacggtgcggcgcccactggctacgtagcgtaacggctttagccgccagttgcggtgtaactgaaatatcaaatttcagactgccggtgaccgtgacctgattgttcttcgcgcccaatgccacaaagcgttcgccatcttcttcgttttgcgcggcaatcagggtgatacggcgcaggagcgtacggacaaacttgccaagcttcgcataacccgcggcggagcgggcggaaagccgcgcattagcgataaccagcggaatatgacgtttgtgcagcgcagcaatcagatttggccagagctcagtctccatgatcaataccagcttaggatcaatcttattgaggaaacgattgagcgcatcgggcaaatcataaggtaagtaaacgtgctgaacatcgttgccaaaggcggactggacgcgctccgagccggtcggcgtcatggtcgttacggtaataggcagatcgggatagcgatgacgtagagcgcggaccaatgggatggccgccagagtttcgcccaccgagacggaatgcagcatgattccgcccggtttcaacggacggcggtagaatccgtagcgttcaccccagcgcttacgataggccggcgctttacgtccacgcacccaaagccgtatccagatcagaggctgaataaggtagagaagagcggtgtaaagcaattcgagcatagtaaatagctgacttatggatgtgctggggattctatgtatttagcctgggctttaccattacttttcccatttttgcgccaaattggctcagaagggaggattccaggcgctgaaccccattatttttgcatttttacgcaatccattgaaatttgccgcccttgtcgccccagacaatgggaatgaccattcacaagagggggataaattattatctctttgaatttataattaaaaaaatgattgtgtataaaaattattcgtatcggattgctgcgaaagaagtgttacactagcgcatctaaaatgagtgcggtattagccatcgggttgctgtgaagcctggggcggtagcgtgcttttttctgcttatttatccggacaatttcaaccaaagagtcgcttgtggaaaagccatttcgaagaattctgattataaaaatgcgttttcatggagacatgttacttaccactcctgtcatcagcacgctgaagcagaattatcccgatgcaaaaatcgatgtgcttctttaccagaacaccataccgatattgtcggaaaatccggagattaatgcactctacggcatcagtaacaaaggcgcaggaacaaaagagaagatcaaaaacgcgctatcgttaatcaaaaaattgcgtgctaactcgtatgatctggtcgtcaatctcaccgatcagtggagcgtggcgcttattgtgcgttttttaaacgcaaaaataaaaatctcgcaagatttcggtaatcgtcagtctgctttatggaaaaaaagctttacacatttagtaccttatgcgggagaacatgctgttgagcgcacattatccgcgctaaagccgttagcgctaaaacagtatgtcacggaaaccaccatgagctatcgcccggaacattgggaaaacatgcgacaacagctcaaacaacttggtgtgacccgacaatatgttgttattcagcctacggcacggcagctatttaagtgctgggataatgataaattctcgcaggttattgatgccgtgcagcgccgcggttatcaagttgtactgacgtcaggcccggccgcagacgagatggcctgcgtggatgctattgcatgcggctgtgagacaaaaccggttactggtctggcgggtaaaactcgctttcctgaattgggcgcattgattgaccatgcggatctctttatcggcgttgattcggcccccggtcatattgccgcagcagtcaaaacgccggtcatttgtctttttggcgcgacggatcatgtattctggcgtccctggaccgacgacatcattcagttttgggcaggaaattatcagccgatgcctgaacggcatgagcttgatcgtaataaaaaatacctttccgtgattccggctgaagatgttatcgccgcgacggaaaaaatgctgccgcatgaggcacgccccatagatttggacagcctgctatgagagttgccttttgcttatataaatattttccttttggcggtctgcagcgtgattttatgcatattgctcaaaccgtggcggcgcgaggtcatcaggttcgtgtttatactcagtcatgggaaggggaatgcccggataactttgaattaatccgcgtgccggttaaatcccggacgaaccacggtcgtaacgcagaatattatgcctgggtgcaacaccatttgcgcgaccatcctgtcgatcgggtggttgggttcaataagatgccaggccttgatgtgtattacgccgcagacgtgtgttacgccgaaaaagtcgcacaggaaaaaggatttttctatcgcctgacatcacgctatcggcattatgctgcttttgaacgcgccacgtttgaacacggcaagcagacgcaactattaatgctgacgaataagcagattgctgacttccaaaaacattatcagactgaagcggagcgttttcatattcttcctccggggatttacccggatagaaaatatagccaacagatcccgaacagtcgtcaaatttatcgtcagaaaaatggtatctcagaacagcaaaaattactgttgcaagtagggtctgactttacccgtaaaggtgtggatcgctctattgaagcgctggcatcgctacccgaatctttacggcaaaatacggtgctctgtgttgtcgggcaggataagccgaagaagtttgcagcactggctgaaagaagcggcgtcggcacgaatgtgcattttttctccggacgtaatgatattgcggagttaatggcggcagccgaccttttactgcatccagcctatcaggaagctgctggtattgttttgctggaagccattactgctggtttgccggtgttgacaaccgcggtgtgcggttatgcacattatattgtggatgcaaactgtggcgaagcgatgacggaacctttccgccaggatgcgctaaatgaggttttactcagagcgctgacacagccttccttacgcagcgcctgggctgaaaatgcgcggtattatgctgatacccaggatttatacagcttaccggagaaggccgcagatattatcacaggtgatttagatggttgagctgaaagcgccgttaaccacactatggcgcggtaaagatgcttttgaggaagtgaaaacgttacagggcgaagtgttcagagaactggagatgcgtcgaacattgcggtttgagctggacggcaaaagctacttcctgaagtggcataaaggcacttcgctgaaagaaattgtgaagaacctgatttcgttacgtatgcctgttctgggcgctgacagagaatggcacgccattcatcgtctacatgagctgggcgttgatacgatgcacggcgttggttttggtgaaaaaggcgtaaacccgctaaccagaacatcatttattatcaccgaagatttaacgcctaccattagccttgaagactactgtgttgactgggctgttaatccaccggacgcgcaggtgaagtggatgattattaagcgtgttgcgactatggtacgtaaaatgcacgccgggggaattaaccatcgcgactgttatatttgccactttcttctgcatttacctttcactggtcgcgaagaggatttaaaaatctccgtaatcgacctgcatcgcgcgcagatacgtcagcacgttccccttcgctggcgtgacaaagatttaattgggctttatttttcttcaatgaatattggcctgactcagcgagatatattccggtttatgcgtgagtatttctcactccccctgcgagagattttgcaaaaagactcggggttgattcatcaggcggatgttaaagccgctcgaattaaagaaagaacaataagaaaaaatctttaaattattatactgacttattatttgatttggactacatgtcatgaaagtattaattataaatgatacaggtaactcttatcattggggatgttatggaacatcgactgcgataaaagaaagtttaaggtttcgtggtattaatgaaatagtcactttctcgtgcgaagaaggtagtaagatagaaaactcacccaaaaaaattctgcttgtgtacagtaagaataagttaataaggaggttagctagccattattatagcaaacatcttcgcaggaaattacctgatttatgggattcattattaaaaagtgattgcgttataataaatggtgaaggaactattaatagtattcatacggcaacaagatttatattttttataattcacgttgcaaaagatatacttaaaaaaaggtttatctaataaatcactcttgttatcctaaattgggtaatgagaaacaaatttattattataagtgtgcttattcacgatgtaattatgttgcggcaagagaaaaaaaatcgcatgaattaattactaatatattaggcattgatgctactttatcttttgatagcttgccgttacttgtcaaaaaggttgaaagcgaaattccagaaagtttgtataaagaaaaatacgtatgtttatctggtgcggttaattataataaagaaaattcatcttttatagctggtgagattttaaagaaatataaaaatcacaaattagtttatcttgtcggctctccatctggtatgaataatgaggagccagatgtaatcgaaagcctgaagaaatttatgcctgaactaattattcatgatgcgaagtcttttactgaatggctatctgttattaagaactcagtagtactaatctcaggaaggtaccattattctattgcggcaatgtgttttggtacaccaacagtatgcttttcatctaatacaccaaaattggatgaaattaataagatgtttaatttaccaggctgtgtcagaacacatgatgaatttactaaagcgcttaacgaaattgacaatttaacatggcaaccactttctaaagagatgtctgacttagctgaatacaactataatttcctttaatttattgaggttgattaataggttattataatattaactttctaattcataagaatattatgaaaataacgtttgttggcgaagcggtatctggcttcggagggatggaaaccgttattagcaacgttatccatacgtttgaaaatagctctccgaaaatcaactgtgaaatgtttttcttttgtcgtaatgacaaaatggataaagcatggctaaaagagattaaatatgcgcaatcattctcaaatataaaattaagttttcttcgtcgatctaagcatgtttataattttagtcagtggctgaaagaaacgtcaccggatattgtgatatgtattgatgtcatctcatgcctttatgccaataaagcacgtaagaaaagtggtaaacagtttactattttctcgtggccgcatttttcgctcgaccataaaaaacatgcagaatgtataacgtacgcggattatcatctggccatcagtagtggtattaaagaacagatgatggcacgggggatctcagagcaagatattagcgtcgtttacaatcctgtctctattaaaacaatcattgtgccgccgcctgagcgcgataaacccgctgtatttctctatgtagggcgtcttaaatttgaagggcagaaaagagttaaagatttatttgatggcttagctcgtacgacaggggaatggcagctacatattattggtgatggctcagattttgaaaagtgccaggcctatagccgggagcttggtattgagcagcgtgtgatctggtatggttggcaaagcgcgccgtggcaagtcgtacagcaaaaaataaaaaatgttaccgcgttactacttacctctgcatttgagggatttcctatgactctgctggaagcaatgtcatatggaattccatgtattagttctgattgtatgtctggtccgcgcgatatgattaaacccggtttgaatggtgagctttacactccgggtgctatagatgattttgtaggacaccttaatcgagtcatttccggtgaagtaaaatatcagcatgatattattcccggcacgattgagcgattttacgatgtgctatattttaaaaattttaataatgcgatattctcgaaattacaaaagtgatcactatgagcagaaaatattttgaagaagaagtcattcaacagactttagattataactatgcacaacatagtgatgctaataaatttaatatagcttatgggattgataaaaactttctttttggctgtggtgtctctattgcatcggttctcattgctaaccgtgagaaggcgttagctttccatgtttttaccgatttctttggccctgaagatcagcagcgatttgatgcattagcaaaacagtacgctacgcagattgttgtttatctcattgactgtgagcgattaaaatcgctacccagtaccaaaaactggacctatgcaacatactttagattcattattgccgactatttttcagataaaacagatagagtgctttatctggatgcagatattgcatgtaagggaagtattcaggaacttattgatcttaatttcgctgaaaatgagattgcggcggttgttgctgaaggcgagttggagtggtggactaagcgctcggttagcctggcaacgcctgggttggtttctggctattttaatgccggttttattttaattaacatacctctttggaccgcagaaaatatctctaagaaagcgattgaaatgctaaaagatccggaggtagtacagcgcataacgcaccttgatcaggatgtattaaatatattgttagtgaataaagcgcgttttgttgataaaaaatttaatacgcaatttagtcttaactatgaattaaaagattcagttattaatccagttgatgctgagactgtatttgttcattatatcggaccaacgaagccctggcatagttggggggcttaccccgtgtcacaatattttttacgggctaagagcaactcaccatggtctcattgtgcacttttaaatccagtcactagccatcagttacgttatgcggcaaagcatatgtttaatcagaagcattatacttcgggtataaattattatatagcctactttaaacgtaaacttcttgaataaaacccataggtgatgtaatggattcatttcctgagatagagatagctgaatataaagtttttgatgaaagtaataataatgatgataacgtattaaacatttcttatggcgtcgatgaaaactatcttgatggtgtgggggtatcaatcgcttccgttgtattaaacaataatatcccgcttgcttttcatattatttgtgactcatactccccgtgttttgtaaaatatatagagcgtttagccgtacagcatcacattaaaatttctctttatcttattaaagtagaaagccttgaagtattgccccaaactaaagtatggtcgagagcaatgtattttcgtttatttgctttcgattatctcagcaagaaggtaaacaccttactttatttggatgccgatgttgtatgtaaaggatctttgcaagatcttctacagcttgatctgacagagaagattgctgcggtagtaaaagatgttgattccatccagaataaggtaaatgagagattaagcgcttttaatttacaaggtggttattttaactccggcgtggtttttgttaacctgaaattatggaaagagaatgccttaactgaaaaggcatttttacttctggcaggtaaagaagctgactcttttaaatatcccgatcaggatgttttgaatattctcctacaggataaagttatttttctacctcgaccatataataccatttatactatcaaaagtgagttgaaagataggtcacataaaaaatatagcaatataattaatgataatactattttaattcattatacgggcgctacaaaaccatggcatgcctgggcaaattatccttcagttatctattataaaaatgcacgactgaactcgccctggaaagattctcctgcaaaagatgcgcgtaccatagttgaatttaagaagcgatataaacatcttctcgtgcaggggcattattttaaaggccttctggctggaagcgcatatctttatcgtaaacttttccacaaataattcccttccctaaatctccattatgattattgaaaaaaaggttaaaaactataccgtctttgtcaaaaaagacggtgaaaaatatattgagatattcaaagattttctatcttataatcatcaggttattaaagtcttccgtaatatagaagatacaaaagttgtattgattaatacagactacggaaaatatattctcaaagtatttagtccaaaagtaaaaagtactgaacgctttttcaaatcgttagtaaaaggagattactacgaaaagctttttcatcagacagatcgcgtgcggcgtgaagggtttgcggcgcttaatgatttttacctgctggcggagattaaaacattacgctatgtaaaaacatacgtgatgataattgagtatattgaaggtattgaacttgttgatatgccagaaatttctgacgaggtgagagggaaaatcaaacagtcgatatattctctgcatcagcatggtatggtttcgggcgatccccataaaggtaactttatcctgcaaggtaatgagatcagaattatcgatttgtccggaaaaagaccttccaggcaacgaaaagcaaaggatcgtattgatttagaaagacattatggtatcaaaaataatgtgagagatattggattttacttattgatttataagaaaaaacttcgaaatttcttgcgtcgtattaagggtaaggaaaagcgctgatcaatgtagcacgtttggtttaatttaaggggctgactgacttttatttgctgcagcgttatgacatacttgagagaatttgagatgtaatattagctattgaatataacatttatttataggttgcatgataaacatacgagttttttatgggcagcgttaacttcataactcacgccgatgttctgcaacttattgcgaaaagaacggctgaagattgtattatttttctttctggccctacgtccagaaagacgccgctgtccttgttacgaatgaaagatgtcattgcagtcaatggttctgttcaatatttgctaaacaataacgtcaagccatttttgtaccttctgacggatgttcgcttcctccatcgccggcgcgaagatttttataactttagccgtaacagtcagtttactatcgtcaatcttgatgtgtacgaacaggcttcagtggatgatcaaaaatatattgaagaaaactgtttaattattcgctccttttatcgccgagaaaaagggggctttttaaagaaaattaaatttaatatcctcaagcgggttcataaagcattacttatttcagttcctctttcgaaaagaggacgactggctggattttgtaaggatatcagcatcgggtattgctcttaccatactattgcttataccgctattcaggttgcctattccctcaagtatggccgtattatatgttctgggcttgacttaacagggagttgcccacgtttctatgacgaatctaccagccctatgccatctgagcttagtaaagacctgtttaaaatactgccattttttacttttatgagaaaaaatgtgagtgatttaaatatctttaatttatcagatgatactgcaattcattacgatattattccatatattacagcctcggaacttgaagatgaaatatattacgataaaattgtctagacactagataaatcattattttgcgttgcttcggcacgcatttctttttctataatatatcttttctataaagttaactattctggattatagctattatgattaaaaaaatcatatttactgttactcctatattttcaattcctcctcgtggcgcggctgcggtagaaacctggatttaccaggttgcaaaacgattatcaataccgaatgctattgcttgtataaagaatgccggctatcctgaatataataaaataaacgataactgtgatattcattacattgggtttagtaaagtttataagcgtctttttcagaaatgggctcgtctcgacccactaccctattcccagcgcatccttaatattagagataaagtgactacccaggaagatagcgtcattgttattcataatagtatgaaactgtatcggcagatcagagagcgcaatccgaatgcaaaactggttatgcacatgcataacgcatttgaaccagaacttcctgatacggatgcaaaaattatcgtgcccagtcagtttcttaaagcgttttatgaagaaagattgcccgccgctgctgttagtattgtgcctaatggtttttgtgctgagacttataaaagaaacccacaagataatcttcgtcagcaattaaatattgcggaagatgccaccgttctcttatatgccgggagaatttcgcctgataaaggcatcctgttgcttttgcaggcgttcaaacaattacgtaccttaagaagtaatattaaacttgtcgttgttggcgacccttatgcaagccgcaagggtgaaaaagcagagtatcaaaagaaagtactggacgccgcaaaagagattggaactgattgcattatggctggagggcaatcacctgaccagatgcataacttctatcatatagccgatctggttatcgtgccatctcaggttgaagaagcattttgcatggtggctgtagaagcgatggcagcaggaaaagcggttcttgccagcaaaaaaggggggattagcgaatttgtgttagatggcataacgggctatcacctcgcagaacctatgtcgagcgacagtataattaatgatattaaccgtgcgcttgctgataaggaacgccaccagattgccgaaaaagcaaaatccctggtgttttcaaaatacagttgggaaaatgtagcgcagcgtttcgaggaacaaatgaaaagctggtttgataagtgattgagtcctgatgatggaaaacgcgctgataccgtaataagtatcagcgcgcttttttatctatttcttagcgccagcagaaaaccggtaatgataccaatttgagcaatatcgacctgttcaaaattgccacgaacgatataaaaaccgacgaaagataaaaatagcaagagatgagcattgtaggggcttatctctactttcctgaaggtagagctggctgtttccctgatgatagcgccatataaataggccaggctcgccagacccaatatgcctgcactaaaccagatgtacagaatggtattatgcggaccgatagattctttaaaggtccacgttggataatcgacaacgcgtttattataaacactatcatacacatcattaccatagccgtagcccttgatcgggttttcctgaatcagtatccacgcggtgccctgggttccgttagtataacgatatgagctatctgtctgctgtaatttataaagtaaatgttctgggtctggtttgttagtatgttgagtgataaccaaagcgccgataatggctaataaaatggcaccaactcctattaacttccattggcgattcagtattgcccatagaacacctactatgagcactgccaaccatccccctcgcgatagggttcccaggataaagaaaaggtagatagcgctaagcaccaaaaaaaccaacttaattgaattttttctaaacaaccaaatattcaataatgctggaaataagaaaaccatggaatcggacatatgtcgatgcgcatagcttatgaatggcataatccctttattatagtcctcgatatacagaatactctctgcaaggcagcgaagtcctaaacttgttaaaaaggagaaaagtactattttcgcaatcgtttcttttgtttcatcttttaatagtacgggaattaataaagtatataataagaaaccctccagtaccgtattttcaaattctttgaaactttctttcatatctggcgatatgagtatggaataaacaaggattaatgataatactgctgcgctataaaatacgctatttttgaaaagaggggggaaacttttcggtgagcgtgagacctgataaatcgcggtgataaccataagtatgattatcaaatgtttataacgcgtaataccatccagaaaatacgtggcaacaaaaagaaaaaccagcgctttattccagatcggcttccatttctctttatttaacgttaatgatgtggttagcatcttttctccacaataggtttgggatgagacagagtctctttaatgaatctttccaaatacgcttgtggcatctaaattcgccaggttttgttctggtgagcagcatgccatttggttcttcccataacctccaattaacccagggtccgttgggccatatagcgtaatattcggtctgtcgagcgcggcggtgagatggctcaggccggtatcaaccgatacgacaaattttgcgccagccagcactctagcgacctcctccaggctcatgcgcggtaacacatccacatagtcaaagccttcggccagtcgtttagcacgagcctcctcatgaggcgcgccccagggaagttttatccgtaatccggtgttgcccaccaggccgataagctcgcgccagtttgcttccggccagtgtttatcatcgcgggtcgtggcatgtaaaaacaccgcatacggatcgctaaccgcctgctggcaatgcagaaaatgttttgcgatggcataatcgccctgcgactgcggtttatcgtatcccaggcttttggcgaacagctcgcgcgtccgttcaaccgcatgttgttgctttgcgatatggtgtttacggttataaaacaggctggccagcggttcgcgggcggtactccagtccataccgtgctttatcccatgcgccagacgcgtcaccagcgccgcgctttttaccagcccctgcgcatcaatcacagcgtcgtattggtatgcgcataccgcccgatgaaaggctatgcgttccgctttaatgggcgcggaaaaccaggccttgcgccaacggcgaatagcgacgggaatcacgcgatcgacagcactgtgccaggacggaatttgtgcaaacccttcttcgacaacccaatcaaattgaatccccggaatcgcctgttgcgcgtcggtaagcgcaggcagggtatgtaatacgtcgcccatcgatgatgttttaacgatcaaaactcgcattaaacgccctcttccgacaacagcgaatgaagctcttccagaacccgctgcggcgtgatatcgatcaggctctggtgatagccttgcgccgtatcgcctttacgcactttgtggtaacccgtaatgagacgaatcacccgggccttatgagacagcggcggcgtgaaatccgggctacttgggccatacaacgcgaccagcgggcggtcgagcgccgccgcgacgtgcatcagcccggaatcgttagtgacgatggctttacaggcggctatcagaatgacggcctgttccagctgggtttcccctgccaggttgcgacaccatgcctgttgctcgctattcagcgccgccaggatctcatttccggcttcatggtcttttgccgagccaaacagcacgacctgatacccttcgttaatgagctgctttgccagttcggcgtagtgatagtgcggccaacgttttgccgggccaaattctgctccggggcaaaagccgattagaggacgttcagaagatagcgaaaaatcgctgtacatcagcgatttttcaccctcgctaacctggagctgtggccagagcagcggctgcggcagatctttcgccgtgcgcatcacgcccttgtcataggccagcgccacgtagcgctccaccatcagcggccaggcgtctttatcaaggacgcgcgcatcgttcagcaggccatagcgcatttcgccacgccagccggtacggtgcgggatattggcaaagaaaggaatcagcgccgatttaaacgaatttggcagcacccaggcgcgatcgtagcgcctctctcgcaggctatggcccaatctgcggcgctcgccgatttccagcgcgccgtggcccagcggcatgggtatcgcctcgttaacttccggcatacgcgataacaacggacggcaccaggctggcgccatcacgtcgattatcgcctggggatagcgcgctttaagcgtgcgatagagactttgcgacatcatcatgtcgcccacccaggacgggccaatgaccaaaattttcatacttacgcgtcgcggttcagccaggccatatactccgtgacgccttcggcgacggtcttaaagggtttgtcgtagcccgcgttgcgcagattggttaaatccgcctgcgtaaacgcctgatagcgacctttcagcttatccgggaacggaatgtattcaatgctgccttttttatggtatgccagcgtcgcgtcggcgacggcctggaaagattccgcgcggcctgtgcccaggttaaagatgccggacttgccgctttccaggaaccacaggttaacggcggccacatcgcccacgtaaacgaagtcgcgcttgaagttttcgctgccttcaaacagtttcggactttcgccgttgtttaactgtgtattcagatgaaatgccacgcttgccatgctgcctttatggccttcacgtggtccatagacgttgaaatagcggaaaccgacaatctgcgagttcgcttctggcaggatctggcgcacgtattcatcaaacaggaatttagaatagccgtaaacgttaagcggtttttcgtattcacgcgattcgatgaaatcagacgtgcgaccgccataggtggcggcagaagaggcgtagaggaacgggatttcgcgctcaagacaatagtgcagcagctctttggagtattgatagttattatccatcatatacttgccgtcccactcggtggtggaagagcaggcgccttcatggaaaatagcttcgatatcgccgagctcttctccggacataatctggatcaggaaatcttccttatccatatagtcagcaatgttcagatccaccaggtttacaaacttggtgccgtctttcaggttatccaccaccagaatatcggtgatacctttatcattcagggccttaacgatattgctgccgataaagcccgcgccgccggtaacgatgatcataactgtaacctttgaattatggtgtcagagactgtctcagacatgaatgcttttatcatatcactattcatccattcactgataactcgtgaggatacgcgtgatttatgctgcattttaaagaagtgatgacgcgtcatctcgtatcaccgtatagctttgggtaatatgtgctgaaatttgcccagtctggagaatcgcaatgcgtggggatttttacaaacagttaaccaacgatctggaaaccgcccgggcggaaggattgtttaaagaagagcgcattattacgtctgcgcagcaggcggatatcaccgtggcggatggaagccacgttattaacttttgcgccaataactatctcgggctggcgaatcaccctgagctgattaatgccgcaaaagcgggcatggacagccacggtttcggtatggcgtccgtgcgttttatctgcggcacccaggacagccacaaagcgctggagcaaaagctggcaagcttcctcggcatggaagatgcgattctgtattcctcctgtttcgacgctaacggcggcttgtttgagacgttgctgggcgcggaagacgctattatttccgacgcgctgaaccacgcgtctatcattgacggcgtgcgtttgtgtaaagcgaagcgctatcgctatgccaacaacgatatggtagagctggaagctcggctgaaagaggcgcgtgaagccggcgcgcgtcatgtcctgatcgccaccgacggggtgttctcaatggatggcgtcatcgccaatctgaaaggcgtctgtgatctggccgataaatacgatgcgctggtgatggttgatgattctcacgcggtaggctttgtcggcgaaaacggtcgcggttcccatgaatactgcgacgtaatgggccgcgtagatattattaccggtacgctgggcaaagcgttaggcggcgcatccggcggctataccgcggcgcgtaaagaggtcgttgagtggttgcgtcagcgttcccgcccatatctgttctccaactccctggcgccggcaatcgtggcggcttctattaaagtgttggagatggtggaagcgggcgcagaactgcgcgatcgcttgtgggcgaacgcccggcagttccgtgagcagatgtctgccgcgggatttacgctggcaggcgcggatcacgccatcatcccggtaatgctgggagatgcggttgtcgcgcagaaatttgcccgcgaactgcaaaaagagggcatttacgttaccggtttcttctatccggtcgtaccaaaaggtcaggcgcgtattcgtacccagatgtctgcggcgcatacgcctgagcaaattacgcgtgcggtagacgcgttcacgcgtattggtaaacaactgggcgtgattgcctgaggatgtaagatgaaagcgttatccaaactgaaagcggaagagggcatctggatgaccgacgttccggaaccggaagtcggccataacgatttgctgattaaaatccgtaaaacagccatctgcggcactgacgttcacatctataactgggatgaatggtcgcaaaaaaccatcccggttccgatggtcgtggggcatgaatatgtcggcgaagtggtcggcatcggtcaggaagtgaaaggctttaaaatcggcgatcgcgtctccggcgaaggtcacatcacttgcggtcattgccgcaactgccgtggcggtcgtactcacctgtgtcgcaacaccaccggcgtgggcgtcaaccgtcccggctgcttcgcggaatacctggtcatcccggcattcaatgcgtttaaaatcccggataacatttctgatgatttagcctctattttcgacccgtttggtaatgcggtgcatacggcgctgtctttcgatctggtcggcgaagatgtactggtatcgggggcggggccaatcggcgtaatggccgccgcggtggcgaaacatgtcggcgcgcgtcatgtggtgattactgacgtcaatgaataccgtctggagctggcgcgcaaaatgggcgtcacccgcgcggtcaacgtcgcgaaagagagcctgaacgacgtcatggcggagctgggaatgaccgaagggtttgatgtgggtctggagatgtccggcgcgccgccggcgtttcgtaccatgctggacaccatgaatcacggcggtcgtattgcgatgctggggattccgccatcagatatgtctatcgactggacaaaagtcatctttaaaggcttgttcattaaaggtatttatggtcgtgagatgttcgaaacgtggtacaaaatggcggcgctgatccagtccggtctggatctgtcaccgattatcacccatcgtttctctgttgatgattttcagaaaggttttgacgccatgtgttcaggccagtcaggaaaagtcattctgagctgggattaatatgtatatacccaaaataattcgagttgcttaaaggcggcaagggagtgagtccccaggagcatagataacgatgtgactggggtgaacgacaaatctgccgggagcagatttgaacgtcgcgtgcgacggcccgtcagggcgaggcccatagatgggccgagtaatccgtagccaacacataagcaacttgaagtatgaagggtatagagacccaatgatatttatcgggtctgatatacgtttcatcgtaaaaggttggtgtcattcgccaaccttttttgttagggaaaatctggaaagctgtaaagaattgtcatagacatcaagcattcgtaattgcgctttaatcttattttactcgctaacgtcacgccctactctgagttttgtgcttgctttttactgtaaaaattaattatggcggcttaatagtttcttaatagagccacagtataaaggcagggtaaattaaggtttttctggtaatcgttatgaaaaatagtaaaaccaaagtgagtatcattatcccgttatataatgcgggagcggattttaatgcttgcatggcgtcgttaatcgcgcaaacgtggtcggcgctggaaattattattgtgaatgatggatcgacagatcattccattgagatagcaaaacattacgcggaacattacccgcacgttcgactgcttcatcaggccaatgctggcgcatctgtcgcccgtaatcttggtttgcaagcggcgaccggagattatgtcgcctttgtcgatgcggatgacctggtctacccgaagatgtatgaaacgctgatgactatggcgcttaacgatgatctggacgttgcgcagtgtaatgcggactggtgcgtccgaaaaaccgggcacgcctggcaatctattccgaccgatcgtctgcgttccaccggggtattaagcggaccggattggttgcgtatggcattggcctcgcgacgctggacgcatgttgtctggatgggcgtttatcgacgtgcgttaattaccgataacaatattactttcgttcccggactacatcatcaggacatattatggtcgacggaagttatgtttaatgccacgcgcgtacgttataccgaacaatcattatataaatatttcctgcatgataattcggtaagccgtttgcaaagacaaggcaataaaaatcttaattatcagcggcattatattaaaattacgcggttattagaaaagctcaatcgtgattatgcccggcgtattccgatttacccggagtttcgccagcaaattacctgggaagcgttacgcgtttgtcatgcggtgcgtaaagaacctgatattttgacccgccagcgtatgattgccgaaatttttacttctggcatgtatagacggatgatggctaacgtccgcagcgcgaaagcggcttatcagacgctgctctggtccttccggctgtggcaatggcgcgacaaaaccttgtcgcaccgtcgtatggcccgtaaggcgctcaatctgtcttagcgctcatgtttttaggcgcggcgattttcccccagccttgccactggtgctgaaaccagacaatcacggaactttgcgtaatgctctcgccgatgacgctgaaaaagcgcgtagcgtagactggttgcagcggttttttcggcttgcacatcttcacgccgcgaaagggattgcgcggcgcgtcaattttctgcggcgtcaaatcaggtcgagacgtatctacctgcggttcgttgagcaggctgcctggacgtaccagggtgatatctgccggcaggcgataaaccatctgttgcagcacgcgaaccgttgcgggatgcggatgaccaatcgcgatagcggaaccgttgcgacgggccagttcgatagtgcgattaaactgacgacggatatccgcctcgttttgcgtatcgtcgaggaacactttgcgcttgatcactttcacacccgtaccggatgccgcgcgcatcgcctggctattgccaatcgtcatgctgtcgagaaaatagagattgtaatgttccagcgcctgcataactttttgcataccgaacaggctggaagtcattgcgctgcccatgtggttattaagcccaacggcatacggcacgttgtttaccgcctcgcggataatgcgctcgatctcatcgctgctcatatctggtcgcagcgtatccttctccagcggctgtttgcttagcggcgccatcggcagatggattaacacctcatgcccgctattgtgcgctttagtcgccatttcgcgcgcgtgcggcgcgttgggcagtacagcgacggagatgtttggcggcagcgccagaacctggttttccgtgtgcgggcgatagccaaaatcatcaatcacgatggcgagcttgccagcgaaaacgggatgtgcaaatgccagcaaagtggccagcgtgagaatggagcgacgaaactgaggcaaaacttatcttcccaaccacggctgtggattgacggcctgaccctggcgacgaatttcgaaataaagcgaaggtctgccctgaccgccgctactgcccacaagggcgataggttgtccggcgcgcacctgcgcgcctacgctgaccagcgcgctctggttatagccgtaaaggctcatatcacctttaccatgctccacgaccaccaccaggccatagccttgcagccagtccgccagaatcaccctgccgtcggcgatggctttgacctcggtgccttccgacgcgccgatcaccatccccttccaacgtagctcaccctgcagccgttcgccataacgatgcaatatcgggccacgtaccggccagtatgcctgaccgcgaggcgcgcccagaccgccggtgcgggacattagcgagcgctcgctttccgtcggcttataggtgctgcctttacgcgaggcttcctgctgcttatcgcgtaccgcctgcgcttcgcgggcttcacgctccgctcgcgctttggccgccgcttccgcccgcgcgatactgttgcgtaggcgtgattcgttggcgcgtagttcgcttaactgttgctggccttgctgaatagacgactccagtccggcaagcgttttcttacgttcattacgcgcctgttccagcttcgcctgctgagcgcgctgttcatacagcaacgtttgttgttggctttgcttctcttccagctcggctttttgcgtggcgacctgttcgcgagtctgtttcagttcggcgatagtctcctggcgcgcctggttcagatagccgaagtaggcctgcaggcgttgcccacgctggctctcttctccgctaagaataagctgaatgccggtgtgttcgccctggcggaaagcggcgtccaactgcgcagcgagattacgctcctggctggctttttgctgctccagtttggcaattgaggcgttcatctcatcaatttgcgcgtttaactgatccagagtgctttgcgtttcgcgcagcttacgcgctgcggccgagatggcctcttcctgggttttcagttgtgccaagaggctggcgcgctgttgctgctgctggcgtacgtcgcgttctttcgcggcgatatcggcctgaatagatttgagttgatcacggtcatccgcgtgggcggaaaaggcgcacaacaatacgccagcgctaagtacgctggcgtagaacaaaggcctgactgaaaacgttcttggtttcacggcctgttgaatggtgttaatcgcctttcccctcatggggagggattattccacgatgaacagcggcttaccagtcatctcttgcgggatttccatccccatcagcgacagcatggtaggcgcaatgtctgaaagtttgccgccttcgaccgccttcacgtttttctcgccgacataaatcagcggcaccggcaggttggtgtgggcggtatgctcctgaccggtcgccggatcgcgcatctgctccgcgttgccgtggtccgcggtaatcaacagttgtccaccaacggactcaaccgcttttgttacctgttcaatgcagttatccaacgcttccaccgctttgatggcggcttccatcacgccggtatgaccgaccatatcgccgtttggatagttacaaatgatggtgtcgtacttaccgctttcgatcgccgcgaccaatttttcagtcaattctgcagagctcatttccggttgcaggtcataagtggccactttcggtgagttgatcagaatacgctcttcaccagcaaacggttcttctacgccgccgttaaagaaaaaggttacgtgcgcatatttttccgtttcggaaatacgcagctgagttttgtcgtttttcgccatccattcgccaaaggtattcgccagcgacgctggtgggtaggcaacggcagttttgatatcggcggcgtattcggtcagcatcacgaagttcagattaaccactttcttacgcgcaaagccgtcgaaatcagcattaacgaaagcgcgggtaatttcgcgcgcgcggtcagcgcggaagttcatgaaaatcagcgtgtcgccgtcttccatcgccgcatcagcctggccctcggcgcggataacggtcgctttgacaaactcatcgttttcatcacgagcgtaagcggcctgcaggccagccacagcggtatccgcctggaattcgccctgggccagggtcatcagatcatacgctttttccacgcgatcccaacggttgtcgcggtccatagcgtagtaacgaccgacgatagacgccacgcgacctttgcccagcgcggcgaatttgtcttcgaattttttcagcgaggcttcagcgctgcgcggcggcgtgtcgcgaccgtcgaggaaggcgtgcagatagattttttctgcgccgcgctctgcggccagctccaccatcgccataatgtgatcttcgtggctgtggacgccgcccgcggacagcagacccataatatgaaccgctttaccggcgtttttcgcctggtctaccgcattggtcaggactgggttagcaaagaaagtacgttctttaatttcaacgtccagacgcgtcaggtcctgataaacgatgcggcctgcgcccaggttaacgtggcccacttcggagttgcccatctggcggtcaggcagacccacttccagaccggatgcgtcgatcagggtatgcggacgttttgcccacagagcatccatcaccggggttttggcgtttaagatagcgttatcctgctgttcttcacggtagccgtagccatccagaatcaccagtaccataggttttttagaaaccgacattgcgacaacctcatactcaatagacaaaataattgcgtaattttactacagctgaatcgataaaatagcctcagaagatcaaagaaagggatcgcgctggcgtgagaaggcaagtaatagcgtgattttttttcgtagcgccccgcaaaaatgcattccagtgcacgctctggctgtatttgcgccactgcgcaggtatactcctttcctggttttttaatcactacgtcgggagttgttaccccccatgcaagaaattatgcaatttgttggccgtcatcccatactgagtatcgcctggattgcgttactggtggcggttttatttaccacgttcaaaggtctgacttcaaaagttaaggtgattacacgcggcgaagccacgcgccttatcaacaaagaggacgccgttgttgtggatttacgtcaacgtgacgatttccgtaaaggccatatcgctggcgcgaccaatttgctgccgagcgaaatcaaagccaacaatgttggcgaactggaaaagcacaaagacaagccaattatcgtggtcgacggttctggtatgcagtgccaggaatccgctaacgcgctgacaaaagccggctttgaaaaggtctttgtgttgaaagaaggcgtagcaggctggagcggcgagaatctgcctctggtgcgcggtaagtgattacccgtcgttttcatgacgcaaggggaatgacttgcccttgcgtcgacatgaaatccatcgggtaaaaaacaggagcgaagtcatggccaatattgaaatctacaccaaagcaacctgcccgttttgccatcgtgcaaaggcgctgttaaacagcaagggcgtgagtttccaggaaattgcgattgacggcgacgccgtgaagcgtgaagagatgatcaaacgtagtggccgaacgacggttccgcaaatttttattgatgcacagcacattggcggttgtgacgacttgtatgcgctggatgcgcgtggtggactggatccgctgttgcgttaaggcgtactcaagtatttaaggacaacactaaagggttttacacatgtcagaacaaaataacactgaaatggctttccagatccaacgtatctataccaaggatgtttctttcgaagcgccaaacgcaccgcatgttttccagaaagattggcagccagaggttaaactagatcttgatacggcatcttcccaactggcggatgacgtttatgaagttgtgctgcgtgttaccgtaacggcttccctgggggaagaaaccgcgttcctgtgcgaagttcagcaggccggtattttctccatcagcggtattgaaggcactcagatggcgcattgcctgggagcatactgcccgaacattctgttcccgtatgctcgcgagtgcatcaccagtctggtttcacgcggtacgttcccgcaactgaaccttgcgccggtcaactttgatgcgctgttcatgaactatttgcagcagcaggctggcgaaggtactgaagaacatcaggatgcctgatgaaccaaagtaatgcgtcaatgacagtcatcggtgccggctcgtacggcaccgctctcgccatcactctggcgagaaacggccaccaggttgtcctgtggggccacgacccaaaacatatcgcgaccctggagcacgatcgctgcaacgtcgcgttccttcccgatgtgccttttcccgatacgttacacctggaaagcgacttagcaaccgcgctggcggccagtcgtaacattctggtggtggtgccaagccatgttttcagcgacgtgctgcggcagattaaaccgctgatgcgtccggatgcgcgtctggtatgggcgaccaaaggcctggaagcggaaacggggcgcctgttgcaggatgtcgctcgcgaggcgttaggcgatcaaatcccgctggcggtgatttccggtccgacgttcgctaaagagctggcggcgggtttgccgacggcaatctcgctagcctcaaccgatgagacctttgccgacgatctccagcaactgttgcactgcggaaaaagttttcgcgtctatatcaatgcggattttatcggcgtgcagcttggcggcgcggtgaaaaacgtgattgcgattggcgcggggatgtctgacggcatcggcttcggcgcgaacgcccgcacggcgctaatcacgcgtggactgaccgaaatgtcgcggcttggcgcagcgcttggtgccgatcccgccacctttatggggatggcgggtttaggcgatctggtgctgacctgtaccgacaaccagtcgcgcaaccgtcgttttggcatgatgcttggccagggcatggacgttaaaggcgcgcaggataagattggccaggtggtcgaaggctatcgcaatacgaaagaagttcgtgaattggcgcaccgttttggtgttgaaatgccaataaccgaggaaatttatcaagtattgtattgcggaaaaaacgcgcgcgaggcagcattaacgttattaggtcgcgcccgcaaggaagagctgagtcgccactagccgtaaggaactgtttgcataaacgacccaacccgcacagaacgggttggtcgttttctgcccgtctggagtaagccatgccgtgtgaagaactggaaatcgtctggaagaatattaaagctgaagcccgcgctttagctgactgtgagcctatgttggccagtttttatcacgccacgctactcaagcatgaaaatctgggcagtgcgctgagctatatgctggcaaataaactggcttcgcccatcatgcccgctatcgctatccgtgaagtagttgaagaagcctatgccgccgacccggaaatgatcgcgtcggcagcctgcgatattcaggccgtgcgcactcgcgatccggcggtggataaatactccacgccgctgttatatctgaaaggctttcatgcgctacaggcctaccgcattggtcactggttgtggaataaaggtcgccgcgcgctggctatcttcctgcaaaatcaggtttcggtctcgtttcaggtggatattcacccggcagcgaaaattggccgcgggattatgctcgaccatgccaccggtattgtggtgggggagacggcggttattgaggatgatgtgtcgatcctgcaatccgtcaccctgggcggtaccgggaaaacgagcggcgatcgccatcctaaaatccgcgaaggcgtgatgattggcgcgggcgcgaaaattctcggcaatatcgaggtggggcgcggcgcgaaaattggcgcaggctccgtcgttttacagcctgtcccgccgcacactaccgccgcaggcgttccggcgcgtattgtcggcaagccgggcagcgataagccgtcgatggatatggaccagcatttcaacgggctacaccatacgtttgagtatggcgacggcatctgaattgcgcggtacaactaaaaaacgctgttccgatggagtgcaatcccggaacagcggagcgaagaattcgcaatgtggacaatcaggctgcggatgatgtcagcgtgatgcgatccagcgggccgacgataaacagatatgaaatgagaccaataagtcccatcgagccaacgtataaaatggcaaagtcgaacgactgagtattggcaagaatcacgccgatgaccagtggcgtaacgatgcttgccatattgccgcacatgttaaatacgccgccagcaatacccagaacttccttcggcgaggtgtcgctgagtacgcaccagcccaggttaccaaaccctttggcaaaaaaggccagactcatcgccgcaatgaccacaaattctgaagaggtgtagttggcgatcacaattacgcaagagagcaacataccgcagataacaggcagtttccgcgcgacggtaaggctatagccgcgtttgagtagccagtcggagaacacgccgccgagcaggccgccaataaaaccggcaatggctggaatactggccacaaaaccgactttcagaatcgacatgcctttcgcctggtacagataggtcgggaaccaggtcaggaagaaccaggtgatagaggtgacgcagaattgcccgatgtaaacaccgatcatcatccggttaacacagacggttttaatctgcgcgaacgttattttctgcggctcctttttacagcccagagagggctcgccaccaccgctacgaatatagtcaatttccgcttgattaacttttgagtggtgcatcggatctttgactttcattaaccagaatataccgaacatcacaccaatggcgccaatataatagaagacaaaatgccagcttaaattatgcagaatgatcgtcattagcggggtgataatgcccagcgagatatattgcgcagcctgataaactgaagtaacgaaacctcgttcattattgggaaactattgtacgcttaaacgactgttcgccggaaaggcaggcgcttcaatcgcgcccatcagcagacgtagagtaaccagtacaattaatgggctgccatacagatagatcgttccctgaaacatggttactaacgaccagccaatcaatgcgcaaccgtaaaccagtcgtgaaccgtagcggtctaatagccaaccgccgggtagttgcataatgacataggcaataccaaatgaggagaaggccaggcccatcgcttccggatcaaaacctaattctttactcattattggggcaactacggatagagttgcgcgatccgcataattaaatacggtagcaagaaataaaaatataagaatggtatgacgcacttttgtgcactttattattgtgttcattatctactcctcagataagggcagaatgcatcctgtaaggtaagagaggcgggacggattcccgccagtcgggttaagggcgtttgccaaattcacatgttaattgtgtccagcggcgcgcttgttcactgagcgtgaaacccagaccatgacgatcggaaatccacatgcggccatcgcgcagctcaagttgctcgttgaataatgggttcagccactcgaaatgttccagccacggctccaggggatacgctgcggaaaggtgcaggtgtacttccatcgcaaagtgcggcgccagcttacgcccgtgtttcgccgccagatccataatcttcaggaacggagagataccgccgacacgcggcgcatctggctgaacgaaatcgctggcattgcccagaatcaactgctcgtgttcccggaaactggtcagcatttccccggtggcgataggcgtatccagcgcggcagcaagctgggcgtggccttcgatgtcgtaagcatctaatggttcttcaatccagataagattgaactgttccattttacgccccatgcggatagccgtttcgcgatcccactgctggttagcgtcaaccattaacgggaactcatccccaagcgcttcacgtactgcggttaagcggcgaatatcctcagcgcagttgggttgtccgactttcaacttaataccgccaatgccattttcgcgggaaatcaccacatttttcagcacttgatcgagcggtgtatgcaagaacccccctgaggtgttgtaacactgaacggagtcgcggtgcgcgcccaacagttttgccagtggcagaccggcacgtttagccttcatatcccataaggcgatatcgataggggagatagcctgtaccgccatcccgctacgccccaccgaggctccggcccacagcagcttggtgtatattttgtcgatatcattggggtcttcgcccagtagattgtcggctatctctttggcgtgagcataaatactctggccgccagcacgtttggagtagctaaaaccaacgccctcaaagccatcgcgactgcggatttcggcaatgatgattgccacttcggtcaaaggtttctggcgaccggtcagtaccttcgcgtcactcactggcgtcgccagcggtagaaaagccagtgatagcttcacccattcgatacgatcgccggtttctgccgcggttctggtattcgccgcttttgcatacgttacggcgtcggaattcgcgcttaaagccattttttttctcctgataaacacaaaatgattgcgctaacatttttattattaagcgaacgcaggatccagaaagttgatgttgatttgaacatttgatcacatatgtcgtataaaaagcaggatttattgcaaaatggatcacgatccaaaaatatctggggaaatgcataatacaaaatgatgtcgctatcattttgtaatgactgagcttgataagctactgtatttacggcctttcctgatgcgaagctggcaatagccgcaggcatgatgaataatgcgcggataaatcagccaatctttgcaggggcatcagacgtgaagagaaccaaatcacctcgtgcgccgacgctggaagatgtagcacgtagcgccgggctgtctccgatgacagtcagccgggcattgaattcgccacaactggttcgccccaaaacggttgagaaagtcatgcaggcggttcgcgtcacaggctacatacccaacgcgttagccggtggtctggcgtcgcgacggagtaaattaatcgctgtcgtcgtgccgcaaattaacaacaacatgtttgtcgataccatccagtcactgagcgatgaactggcccgacgcggatatcacatattgctgtgcgtggcgggatataccgaacaaacggaagcggagttggtggcgacactgctttcccgccgccccgatggcgtggtgcttaccgggatccatcacacgatagaactgaaaaaggtcatcctgaacgcggctattccggtggtggaaatttgggacttaacgcccacgccgcttgatatgctggtcggtttttcccatgaaaaagtcgggcaggcgacgggggagtatcttctgagtaagggctatcgtcgtcccggcttgttgtggaccgccgatcgccgagccgcgcaacgtaagcaggggttatgtagtgttcttcaacgccacgctattcatgccgtaccgcaggtggatgtcccccttccggcatcgctttcgctggggcgtagcggtttaagccagctttttgacgaagggacgtttgatgtcattgtttgcagttctgataccctggcacagggggcgatgatggaggcggaaagccgtggtttgcgcatcccgcatgatttagcggttattggttttggcgaccttgattttgccgccagcaatcgaccgtcaattactaccgtaagcgttgacagacgcgccattggtcagcgcgccgctacgctgttggccgatcgtattgaacagaaaccgtgcgcagaagctattgtggatattggctttcatttgattgagcgagagtccgcataaacgggaacatgccatcgggatcggccaggccggatcaggcgttagccgccatccggcattgaatatattacgaccgcaataccgcgccggggtatcctaactggcgccacgcttcatacaccaccaccgacaccgcattcgacaggttcatgctacggctatccggcatcatcggaatgcgaatcttctgctctttaggcaacgcatcgagaatgctggcgggcaggccgcgcgtttccgggccaaacatcaaataatcgccatcctgatagcttacggcgctatgggcgggcgtgccctttgtcgtcaacgcaaacaggcgctgtggattttcggcggcgacaaaggcggcataatcgtgatggcgctgaaccgcggcgaattcgtgatagtccaaccctgcgcggcgtaagcgcttatcatcccaggcaaaccccatcggttcgatgatgtgcagacgaaagccggtattggcgcaaagacgaatgatgttgccggtattcggcgggatttctggttcgaagagtacgatgttaagcatgatgcccccttaaatgcggggggcagaatagcagaaatttaccgggctctcacgcgccagacgttcaggcggcatcgcctttgctcattggcgccagcgcggcgggcaaacttttccccagttcctgcaccagtgaatcgccactgatttcgctaatggatttcgcgccggtcagggtcatggcgactttcatctctttctcgatcaggtccagtaggttagcgacgccagtttttcctgccgtcgccagcgcgtagagataggcccgacccagcagtacggtatcggcccccagcgcaatcatacgcacgacatccagcccgttacgaatcccgctatccgccagaatggcgatatcgcctttcaccgcatcggcaatggcgggcagggcgcgggcggaagagagcacgccatcgagctggcggccgccgtgattcgacaccacgataccgtcagcgccgaaacgtaccgcatcgcgggcatcttctggatcgaggatccctttgatcaccattgggccgtcccagaattcgcgtatccactccagatctttccaggagatggacggatcgaagttatttgccagccagccgatatagtcctcaaggccggtcggtttacccagataggcggaaatattgcctaaatcatgcgggcgaccgttcaggccgacatcccacgcccatttagggtgcatcaccgcctgccagtaacggcgcatggccgcgtttgggccgctcatcccggagtgggcgtcacggtagcgcgcgcccggcgtcggcatatccacggtaaagaccagcgtggagcagcccgccgcttttgctcgttccagcgcattacgcataaagccccggtcacgcagtacataaagctggaaccacatcgggcgtttaagcgtgggggctacttcttcaatcggacagacggagacggtggaaagggtgaacggaatgccctttgcgtctgcggcggcggcggcctgtacttcgccgcgacgggcgtacatgccgcacagacctaccggcgctaatgccaccggcatcgacaacgtttcgttaaacagggtcgtttccaggcttaaatcggacatatttttcagcacgcgctggcgcagagcgacttgcgacaggtcttccacatttcggcgcagggtatattccgcatacgcgccgccgtcgatgtagtggaagaggaaaggaggcaacgtgcgctgagctgcggcgcgataatcgctggttgctgaaataatcatgatttattctccctggtcatctcattatggtcgccgggcaggcgggtaatgcgcgcctggcgggcctggtcttcatcaaatcgtttaatcgtggtgtggacaaaactgaggtgcgccatcatcgctttacgcgcgccctcggcgttaccgtccagaatggcgtccaacaccgcctggtgttgttccgtcagctttgagaatacgggcggaacgagatacatacgctggcgactctgtttgacggaggattgcaggacgtcgaagaaaccgcgcatggtttgcaacagcaccacattatgcgaggcttccgcgatcgccagatgaaagcgcacgtcggcctgggaggcgagatccgggtcttcgctgagcgtcgcatcaaagcagagtctgattttctctttgtcggcggcggtggcacgcatggcggcgtgccaggccgtactggcttcaatggcgtggcgggcttccagaatgtcgaaactgtagtccggatcgttcgccatcagcattttcagcggttgcacgatattctgttcagaccaggtttcgtgctgccagcggacaaatgtcccgccgccgcgacggctcaccagcacgccttcgctgaccagcttcgccagcgcttcgcgtaaagagttgcgtgatacgccaagctgtagagccaactggcgctcggcgggcaatttcatgcccgcttccaggttttgttcttcaatcagcgcccgcacgcgagaggcaatctcgtctgacaggcgttttggcatcacaatcacggaatcatccaggttaaaacataggcctgaagcgtagtgatcacgcccaccatacaggtgaagatcaggctgtgtttgacggtaaaacggaacagatcggactctttccctaccagtcccaccgccgcgcaggcgatggcgatagactgcggcgagatcatcttcccggttacgcctccagtggtgttcgccgccaccatcagtacatcagagacgccgatttgctgcgccgcggtagcctgtagagaggcaaacagcgcgttagatgaggtatccgagccggtcaggaagacgcccagccagccgaggaacggcgagaagaacgtgaaggcgctgccggtgtgcgccagcgctaacgccagcgtggaggaaagcccggaatagttcgagataaacgcgaacgccagcaccatgccgatggagtaaatcggcaacgccagctctttcagcgtgctgccaaaggtctggattgcggctgagggtttcattttcagccagacaatagacaacagcgcggcaaacaggatcgcagtgccggtggcggagaaccagtcaaatttatacaccgccgcgtaagcggtcgcttcgtgtacgaccggcggcatacgggcgaccagtttatcgagatacggtaccggaacgttaattacccagtcatacagcgcgccgccgggggcaaacagcgctttgaacggcggtatgctccagagcgtgaccgtggcggtcaggaacaggaacggcgaccaggcgcgaacaatttgtcctgtcgtataacgggtgcgggccagcgtctgatcgacctgcgacgcgcccatatcgccgaagcggaagatgcgtaccggctgccagcgtttgaggaacagcgtcagacacaccagagacaccagtgaagagatgatgtccggcagttccggcccgataaagttggagctgagatactgggcgatagcaaacgagccgccagcgaccatcaccgcaggccaggtttctttcacgccgcgccagccgtccataatcgccataatccagaacagcacgataatggtcaggaacggcaactggcggcctaccatctgaccgatttcaaagctgtccaggtccgtgacctgtccggcaaccagaatcggaatacccatcgcgccaaaggcgaccggcgcggtgtttacaatcaggcacagccctgccgcatacagagggttaaagcccaggcccaccagcagcgcagcggttatcgccaccggcgcgccgaaacccgccgcgccttcaaggaacgcgccgaagcagaagccgacaatcagcatttgcagacgctggtcgggggtaatcgacagaattgacgagcgaataatgtcaaactgcccggtcttgaccgaaattttatagacaaagaccgcggcgatgattatccaggctatcggccatagcccgtagaagaagccatacacgaccgatgccagcgcgtgatcgaccggcattttatagaacagcagcgcgacggcgagcgcgataaccaccgtccacgaagcggcaacatagcctttcagcttgagtttaatcagggcgaaaaagaagaacaggattgggagcgatgcgatcaggctggaaagccagatattacccgccgggtcatagttttgttgccagaggttcattgcaggtctcctgagaaccacacgcataatgggatgaatctttgctcatctagttgaagtcacattatgtgtaaaagtggtcctgccaatattgttgtgtatggataatgacaacaaatagttaaccggatgttatttattggcaacgatattgtagagttaatttagtgaaatgtgagtaggctgtggtaactggctaaaattggtagggccaattgagaggagaggaccacaaagggaagtgaaaaggcaatggcattatgccattgcctttgatgtcgggagtgttgttacttcattaccactggaagcccgcgccaatggctgcagagtaatcgccctggctgttgctggttccttgcagtttatacacccagcccccgctttcacttaccatggagacaccaatggcgacggcactttcaccattaaacgtaccgccagcaatcgaggtcatgttggcgcccggggcgtaggcttgtggcagaccggccatcgccatcgctgaagcgataccgccgctcatcttgttttctatgcctttgattttgctgttcatttcccccattttctggtcggtataggtgtttgcttcttcgacgctgcgtttcaattgcgcatagttaaccgcatccgtatcattcaccgccgctgaaacattgccgatccgagtggtgccgccactcccgtctcccaggttgagcacgctatagttaaccgagccatctgcattggtttcataacgcacggagcctgcttctgaggctttcagttgcgccacattaaccgcgtcagtgttgttcacccctgcggcaacgttggtaatacggcgttgttgagtagaagagccgacagacacagtattagcttcatctgcgacggaatttgtgcctaacgccacgctgttttcagcggcagcaatagagccagagccaatcgcgacgctgtccgcaccctgggcatttgcatctgcgccatcggtgttggtcttgaagtacttggtgctaccggtagtgacgatatcgccaatgccgttttcgatattggtgacgcgggtatccagattcgatacctgagtattcaggttagtaatgctctgggtattcctggaaacctgcgcgtccgttactttcaattgaccaacgttaacggcatcggtatctgccgaacccgccgcgacgttagtgatctgacgttgaccgtcttcactgccgacagagaactcaccgacagagttctgcggtgtgtccatgttgtaggcggtgtagtcagtctgtgcaccgcgagtggtctgagaaccattacccattgcaatactgtttgcatggttggcgcgtgcgttagaaccgatagcaatcccgttgatggcatcagccatcaccagtgtattcagaccaataccaatacctgcatcagcattgacgatagtcttcgcacccattgccagtgagtcagttccgacagccagtgaatcttcttccgttgagtttgcgtggtagtacttggtcggtgtagtagtgaccgcaccaatggcattttgtaactgacgaactgttaccgcatcttgcgcttcagagccgtcagcaacgttggtaatttgacgatagctttctccatccgtccccaatgacaacgcgcccagcaactctctgtctgttgtattgtagccaatcaccacgccatcgcttgttgcgctcgtttctcgtataccggttgtaatagcgcggttagaggtggagccactgcccaaagcgatactgccctcaatgctgctgctgctgttttggccaagagccagacagccagcgccagaggcgacggcgtcgtaacctactgccgttgcgccgttacccgttgcgtatgcatcctggccttcaagcccgttatcattcgtacggatgtatttcacgccggtaccattttccgtgatataggtttcgctggtatcgccggctagttggctaatagattcattatactgagaaatcagcatgttagtttcatagagctgagagccattaatggcgtcagtactgtcactggcgatttcacctgctgctacattagttatcttattggtaccgctggtaccgtggctggcgctgaacgcaccctcttcgtcatcccagctcagtgcatcggtaccaaggttggtgatggacgtattgatatccgcgatagcagaggtgttttgatccaccttctggttggtttcatacaactgtgatccgtttaccgcgtctgtactgtcctcagaaagcgccccggcggcgacattggttattttactggtgcttccaccgtggtttgcgctgaaagcgccggtgtcttcgtcccataacagagcgttatcagtgaggccggtaatggacgtattaatgtcggagacagaagtattcaggttctcaatcgcggtgctgttctgagtgatgttggtggtattggcggcgatatcggtcgtgttctgatccactttttcattggtttcgaacaactgcgatccgttaaccgcgtcggtactttcttcagacagctctccggcagcaacgttggtgattttgtttgtcgtactacttccgtggctggcagagaacgaattcgttgtttcattccagctcaggttgtcagagctaagattggtgatggacgtattaatatctgcgatagcagaggtgttttgatccaccttctggttggtttcatacaattgtgagccgttaacggcgtctgtactgtccgcggccagggtacccgccgccagattggtgattttgctggcgcttccgttacggctggcgctgaatgtgccagagtcagcatcccataacagggcatcgtcggtgagcgtggtgacggagttgctcagattgttgatactggtggtgttggtggcaatatcagtggtgttctgattgatgctgttggtattggtggtgatatcagcggtgttctgatccactttctcgttcgtatcaaacaactgggagccattaaccgcatcggtgctgtccgcggccagggtgcctgccgccagattggtgattttgctggcgcttccgttacggctggcgctgaatgtgccagaggctgcatcccaaagcagggcatcatcggtgagcgtggtgacggagttgctcagattgttgatactggtggtgttggtggcaatatcagtggtgttctgattgatgctgttggtattggtggtgatatcagcggtgttctgatccactttctcgttcgtatcaaacaactgggagccattaaccgcatcggtgctgtccgcggccagggtgcctgccgccagattggtgattttgctggcgcttccgttacggctggcgctgaatgtgccagaggctgcatcccaaagcagggcatcatcggtgagcgtggtgacggagttgctcagattgttgatactggtggtgttggtggcaatatcagtggtgttctggttaatgctgccggtatcgttccctgcattggccagcgcatctgcagagaccataatactgctaagaccgacgagtgcggaaaccgccagctttctgcggccgcttttttttccgcggctttttgccgtctcgctggtgacaataaatgttcccgtagcggcattccagaggactttaaatattctgttcatgaataagtgctttccttttctaaaatagttgtatcaatggctattatttttttggcttctttttcgtatcattaataggttgtatgctgtcgaatatgacattctccatgtcaatacctatttttagatacttaagattattgggcgatacgccttttaatgttagcgtgacgtttgtccatgctcccggtaagagttcgattgtcgagtccattttcgtgttgagcaggagttgtcgccagcgaggcagatcttttgcctcggaaggttttttcgtaccccatgtcatattaaacgcaaggtttgatacgggaatgctgagtaagttaactaaatcaagatgaataacacttccattatctattggctcaatagatagaatacgcccggctaatccgatattgccgttgttaataataaaatagtgcgtttgtgatgggtccagttctgtatagtcgaatagccgttgtttgcgttcaacgcggccaacgacttcggcgatcttttgagtcgtgttgataaccgtagtttgttgtttttctggcaaatttatctttacttcttgttctttttgttgtttttctaacaggtttatctttgcttcttgttctttttgttgttttttcagttcttcaacaaggtgcttatctgcgaagtaatcacaaccagacaaaaaaaatgtgaatcccaaagcaagcagggggataaattttccatttttgtacatataaaatatccttgttaataatttatataatataaatagttaacctattatttatacagccaactcatcattttgcgggcattgccaatagccattaacgtatggttataatgaaaacattcattgcttctataggagtgtgcaaatacccgacgttgtttatcaattactcataacaatgctttataaaaatataattataatatttatgtatgagcattttttttcatggatgataatgttatttaatttcgcgggtcaattatattctgcgggttatgagaaaagaggatgaaaaaattcattgtataaatacaaacaggcacgatagtggaattttttatcctgaaaaagcagggattgccgttaaaaatgaacttgtatataaacgatgtaaatacttctaggaaaaattcggaatatagcccgatgcattcaagacaccctccgtacaacgggtgtcttgagagcctgggatgcggaaggtttagaactcgctcttcgcgaaacctgtcatctctttgagtcccatttcccggcccagcgccgtcatcgggtgcactacgatcagaccacgcacgcttttcttcaacttgcccatatcggcctgctcttttttagtgatagcgcggcgaaacggcaggttcatcagcttctgcgcttctttactcagtttctggctgtgtacttcgcgcagacggataatttctgcttccagcgtctctttttctttttccagctccgcgtatttatcggcggattcaaccagcgagagacctgcctgctggtggcgaatagcgtcaagacgatcgctcaggcgtttaatttcgtttttttcgacttctttcatgggatagcttctgatagaaatgggatagataccctatagtatgcgcgcagtgggtgattcttcacaactcatggcgtaacgataatcaattatggtaaatattacaccgctaattatttatttatccatttgaaaataaagtgctttttttcgaaagaaaagatgaaacgcctttttgtcggcaagaaaagcaattaagcacattttcctcaatgatgacgctaaatcgatcctaaactcaaataagcggccgcgggagtcagacgcggatcacacatggaggatctatcatggcaaaaataggtgagaacgtaccacttcttattgataaagccgtcgattttatggcgtccagccaggcgttccgtgagtacttgaataaaacgccgccgcgtgattatgttccttccgaagtgccgtcggagagcacgcccatttatttgcagcgtctggaatattaccggcggctgtaccgaccaaaagaagaaagaggttaacggcgggatttacttttgaaaggccttttttaagctgattttagaaatcagctcggtcagagagagaaccatcgtcgaacgcaccgcctgctggtagcgctgaatttgcatggcgtatagcgccgcgtcggatgtatcaaaatgtggcggcggcggcagcgccatgacgcaatgcagttcgccaaacggcccgaggatttcatcgtcggtaaaggcgtactcattgccgtcgtgattcagctcttcgcgcagcgccattaacagctccgcatcttcatattcggtgcggctgagtacgcccaggccatagataagtttcagacgtaccgaaagatcgcccagcggcccgtcgccgtccagcaacggttccacagcgtatttcacggcatagtcgtctttgcgaaacacctgaagcaccagaatattcaccgcctcggtcagtaactcgacggcggtaatcaggaagctccgtacggttttgccagcattcagacgctcaagcacacgattttcaaaggcctgggtttgttccattattgcctgcatatctgacaatctgttatttgggcgcaggctaacctgcgccgggttctgcgtcatttggtcgcgttatatgcgttaaccgcctccgccaccacatcgctattggcatccagcccggaaatttgcgccagcgcggcctgcgggcctttttcggtaatcagcgccgccaactcttgtgcctgcggatcttcatcgctacggaaatgcatcgccgccgcgatccctttcaccagattcacatgcggcagaccatattccagggtgccaagcagcggtttgatcagacggtcgcccgcgctgagtttgcgtagcggctgacggcctacgcgttcgacgtcatctttcagatacgggttttcaaaacgaccgaggattttctgaatgtatgccgcatgtttgtcggcatcaaaaccgtagcgtttgatcagcaccgcgccgctttcttccatcgcgcctttcaccaccgcgcgaataccctcatcgagaatggcgtcgcgaatggtttgatgaccggctaatttgccgaggtacgcggttatagcatgacctgtgttcagcgtgaagagtttacgttcgacaaatgccatcaggttatccgttaactccatccccggaatgtttggcaacgcgcctttaaactgggttttatcgacgatccactcgctgaaggtttctaccgtcacttccagcggatcgttggtcgcagaagcagatggcggcacaatacggtcaacggcggaatcgacaaaaccgacgtgctgttcaacccaggctttatcgccatccgccagcgcgttcattacgtggcctttcagctgcgtggtgccgcgcaccatattttcgcaggcgatgatattcagcggggcatccacgccctgcgccttacgttttaccagccctttagcgatagccggtgcgatacgctcaagcaccaccgggcccacggcagtggtgattaaatcaacgtgggcaatcaggtcgacaacatcatcgccgatgctgctgacagcgttgacgccggaaacggtatccacctgctcattttcacccacaacatgaacctgatagctatgacgggcattcagggcatcgagtacgacctggtttacatccgcaaacgtcagttgtatccccgcgtcagccagcaatttgccgataaagccacgaccgatattacctgcgccaaaatgtaatgctttcatagtattaaccttcattaatgtttttacccgagagggctggggtgaggcttttccctcaacctaaccctctccacaagagagaggatatcgccttcatatttagaactgcagatgcgttggctctcctcgctcaccccagtcacgtatttatgtacgctcctggggattcactgcgttgccgccttcctgcagctcgaactattttggggatacttaactgttaagcttttttacctgccagcagttccagcacttcatccacgctggtggtgtgcgccagacgttcgatcacggattcatcatccagcgcgttggtcaagctggtgatgacctggatgtgctcattgttacgtgcggcgataccaatgaccagacgggcaatatcgtcttcttcttcaccgaagcgtacgccttccggatactggcagaacaccacgccggttttcagcacgcggtctttagcttctacggtaccgtgcggtaccgcgatggattcaccgaggtaagtcggcgtcagcttttcgcggtccagcatcgcctcgacgtattccggctcaacatagccgcctttcaccagttgttcaccggcaaagcgaatcgcctcttctttgttagcggctttacggcccaggaagatattctccgcgcccagcttgaacaggttgttatcgccctcttcaaagctatctttcagatgatcgcggactttctcttcattagtattgtggcgctgtgcggcaaccagacgttcggtcaggctggtgtacaggccgctatccaggaagttggtcagcgaaatatgctgcgcctgcggtacctgacgcatagcacgttcggtcaggtcgcggtgagtaatgaccagatccacatccggcggcagattgttaatggcgctgttggtgacggaaatctgagacagacccgcatcctgtactttcttacgcagtacccctgcgcccatcgcgctggaacccataccggcatcgcaagctacgatgattttacgcacatggctgaggtcattggtgacgtcgccagccgccagcggagaggcgcctttagattccgctttcatgtcatgcatacgacgggtggccgcttcaatatcatcttcttctttcactttgctggttttcagcagaattgcagacaccacgaaggagaccgccattgccgccacgatggccgcgatgttagcgaagtaagcgccttttggcgtcatcgccagtaccgccagaatggagcctggagacgccggagagaccagaccgccgttcaggatggtcagggtgaatacgccggtcataccgccgagaatcaccgccagaatcaggcgtgggttcatcagcacgtacgggaagtaaatttcgtggataccgcctaggaagtggataattgccgcgccgcccgcagactgtttagcgctgccgcgaccgaagaacatgtacgccagcaggacgcccatccccggacccgggttagcttcaatcaggaagaagatggatttacccatctcatgggactgctggatacccagcggtgagaagatgccgtggttaatcgcgttattgaggaacaggattttcgccggttcaacaaaaatggacgccagcggcagcatatcgtgcgccaccatgaagttaacgcccgccgccagaattttggacaggacttcaaccgccggaccaataccgaggaacgccaggatggcgaggatcataccgatgatgccagcggagaagttgttcaccagcatctcaaaaccggatttgatcttaccgtctacccaactgtcgaatttcttaatgcagtagccgcctaatggaccggcgatcatcgagccgaggaacatcggcatatccgcgccgacaataacgcccatggtagtaatagcgcctaccacgccgccgcgttcgccgccaaccagacgaccgccggtataaccgatgagcagcggcagcaggtaggtgatcatcggaccaaccagtttcgccagcgtttcgttaggcaaccaccctgttggaataaataatgcggtgataataccccacgcgataaacgcgccgatattaggcatcaccatattgctgaggaatcgaccaaagctttgcactttgatcttaatatcggatgacataaaaacaccccttcttatgttgctgtcgcgcaggctgaaagcccgaggtttgttaatgtagcggcagaggtagccggaccctgtagtgtagatactgcgcaatctggcactgaatcgttcaactgtccagacaaggataatttatgtgatttgcgtcacataaatataggggtagagaggtaatttatgtgatattgatcacaaagttactgtgtaaaaaaacaacgaatctcatttttagcccttaaaaggctattttatgtgagatatttcacacttttattttggtgctttgttgaatttttgtgatcctcttcacatgaaattttaagcccgggtaacgtcaatacgatccgacaaacattttgtcgcgagccctctcacgttatgtcattcagcaacttccttttgtgtctcttttcgtcttatttgagccatactatgatttttactggttggcaaaaaggacacggcatgaaactcatcggtagctacaccagcccttttgtgcgcaaaatctctgttctgctgctcgaaaagggtattaccttcgaatttattaatgaactaccttacgaggcggataacggcgtggcgcaatacaaccctctgggtaaggtgccagcgctggtgacggagaaaggggagtactggttcgattcgccgatcatcgcggaatatattgaactgctggatatcgcgccagcgatgctcccgcgtgacccgatggcagcgcttaaagttcgccagcttgaagcgttggctgacggcattatggatgcagcgttggtgtctgtacgcgaacaggcgcgcccggcggcgcaacaatcggaaacggaactgctgcgccagcgggaaaaaatcaaccgcagcctggatatgctcgaaagttatctgagcgacgggacgctaaaaacggatacggtcaatctggcgactatcgcgattgcctgtgcggtaggctatctcaacttccgccgggtcgcgcccggctggtgtgttagccgcccccacctggtcaaactggtcgaaacgctttttcaacgcgaaagctttgcccgcaccgaagcgccaaaggcttgacgcgcattatgtccgcctgagcaaactcacgttacaatcccccttatgtcgatatccctctcccgccaggagagggccaccaacagccaggcattttcatgacaagcgaaacgcgtacactctacagccagcttcctgctatcgatcgtttattgcacgatagcgcctttctttctctgcgcgatcggtatggccatacccaggtggttgatctgcttaggcggatgcttgacgacgcgcgcgacgtcatacggaatacgcaaacgcttcccgactggtacgcagactgggcgcaagaggcgaaactccggctggaaaatgcggcgcaaagcgcgctgcgcccggtgattaacctgacggggacggtgctgcacaccaatcttggccgcgcattgcaggcgcaagaagcgattgaggcggtaacgcaggcgatgcgcgcgccggtgacgctggaatacgatttagatggcgccgggcgggggcatcgcgaccgggcgctggcgacgctgttatgccgtatcaccggggcggaggacgcctgtatcgtcaataacaatgcggcggcggtattgctgatgctggcggcgaccgccagcggcaaagaggtggtggtttcgcgtggcgaactggtcgaaatcggcggcgcgtttcgtattccggatgttatgcgccaggcgggctgtacgctgcatgaagtgggcaccaccaaccggacgcacgcgaaagattaccgtcaggcggtaaatgaaaataccgggctgttgatgaaggtgcataccagtaattacagcattgagggctttaccaaaacggtagaggaagcggaactggcggaaatcgggcgagagctggatattccggtggtggcggatctgggcagcggttcgctggtggatttaagccaatatggcttacccaaagagccgatgccgcaacagctcattgccgcaggcgtcagcctggtaagcttctccggcgataagttgttgggcgggccgcaggccgggatcatcgtcggcaaaaaagcgatgattgcccaactgcaaagccatccgctgaaacgcgctctgcgcgcggataaaatgacgctggcggcgctggaggcaacgttacgtctgtatctgcacccggaagcgttggcggagaaattacccaccctgcgtctgttaacccgcagtgaagcgtcgattcgcgaacaagcgcagcggttacaggcgcggttggcggcacgttacggcgatgaatttgcgctggaggttaaaccctgtctgtcgcaaatcggcagcggttcattaccggtagaccgcctccccagcgccgccatgacctttaccccgcacgacgggcgcggtagtcggctggaggcgctggcggcccgctggcgcacgctgcctgtaccggtcattggccgaatttatgatggccgtttatggctggatatgcgctgtcttgaagacgaaagccggtttatggagatgatgctgaaatgattattgcaactgccggacacgtagaccacggtaaaacgacgttgctccaggcgattaccggcattaatgccgatcgcctgccggaagagaaaaaacgcgggatgactatcgatctgggctacgcctattggccgcagccggatggtcgtgtgctgggctttatcgatgtgcctgggcatgaaaaattcctctctaacatgctggcgggcgtaggcggtatcgatcacgctttgctggtggtcgcctgtgatgacggcgttatggcgcaaacgcgcgagcatttacagatcctacagctgacgggcaatctccagctcaccgtcgcgctgaccaaagccgatcgcgtggacgaggcgcgtatcagcgaagtacgtgaagaggtgctggcggcgctcgacaactatggcttcgccgataccgttttatttgtcaccgccgccaatgaaggacgcggtattgcagaacttcgcgctcatttacagcagcttcctgcacgtttacacgccgcgcagcatcgcttccgtctggctatcgaccgtgcgtttacggtgaaaggggcgggactggtggtgaccggaacggcgttgagcggagaggtaaacgtgggcgatacgctatggttgaccggcgttaatacgccgatgcgcgtacgaagtctacacgcgcaaaatcagcctaccgaccatgcgtatgccgggcaacgtattgcgctcaatattgcgggcgatgcggagaaggagcagcttaaccgcggcgactggctgctttccgatgcgccggcgggggaggctttttcccgggtgatcgtttctctggcgcttcatgcgccgctttcccaatggcaaccgctacatattcaccatgccgccagccatgtgaccggtcgcgtctctttgctggaaggcgcgctggccgagctgatctttgatacgccgttgtggctggccgataatgacagactggtattgcgtgatatttccgcacgcgccacccttgccggcgcacgcgtggtgacgcttaacgcgccgcgccgcggtaaacgtaagccagattatttgcactggctttcaacgcttgccgatgcgcaggacgatagcgcagcgttggccattcatctggaacgcggggccgtcaacctgccggatttcggttgggcgcgtcagcttaatcctctcggtatgcgtcagcttattgagcaacatggttttatccaggccggagacaatctgttaagcgcgcccgtcgccgcccgctggcagcgtaagattcttgatacgctggcgacctaccacgaacagcaccgcgatgaaccggggccgggacgcgagcgtttacgccgcatggccctgccaatggaggatgaagcgctggttctgatgctgatcgagcggatgcgcgacgagggcctgattcatagccatcacggttggttgcatctgccggatcataaagcgggatttagcgatgagcagcaggccgtctggcaaaaagtcgaaccgctatttggcgatgagccctggtgggtacgcgatctggcgaaagagaccggaacggaagaacaattgatgcggctggtgctgcggcaggcggcacagcaaggcatcattaccgcgatcgtaaaagatcggtactatcgtaacgatcggattgtcgctttcgccaatatgatccgcgagctggatcaagagagaggatcaacctgtgcggcggattttcgcgacaggctgaatgtagggcggaaactggccattcagattcttgaatattttgaccggattggatttacacgacgtcgtgggaatgatcatttattacgtgatgcgttattatttccgcaaaaagaatgaaatggttaaattaaataacaaatgaagcaatacaattattgcgttgctttataaaaagcacatcagcaaatgaacctgatgtgctttttatttttctggcttcttaaaatagccatcgtgagcctattatcagaatagttttgcccatattctttgcgccttattcaggcgactcacgacgagattgtggaactttatcgcgcggcgatgtaacgcctttgcccggtggcgcggacgcttaccgggcctgcgtagacgatgcaggccggatagggcgtaacacgttatcttcggtcgagcttttgctgcgccagccagacggcgcccagcctgcctgcctgatttcccagttggcagggctgaatcggcacctggagcgcctcccacatttcaaacgtttcaagatgccgcgtcaggagcgggtagagcttttcctgttcgcttattcctccgccgatcagcaccacgcccggatcaaacatagagatcacgctgtaaacgccgcgtgacagataacgcgcccagtcattgaccgcctcacgcagatgaacatcggtcgccattcgttcgaagatcacatccgcaggcggcatctcttctgcaggcagcgccagagcctggcggcacgacgccattaatccgctggttgacgcgattttatgcatactttcgccattattcccgaccggcatgacgccgaattcaccggcgtggaaatgtgcgccgcgatacagttctcgtccgacgataataccgccgccaatgccggttccaatggtgatacagaccagattgtcataatgctgcccggcgcctcgccacatttcgcccagcgccgcgcagttcgcgtcgttctccacgaccagcggcagatcggttagcccgctgaacaactccatcaggttgacgtcatccaggtatgccagcgcgcccgcttttgccgcatgaccgttatggggattaatatggccggggaaactgaccccgattgccgcaatgtcatagtcctgctggcaacgcgccaccacatcctgccatttgcgggtaaacgtggaggcgtcctctggcgtatcgaattgatgatgggttaattcttcgccgtcactgttaatcacgccatatttgacgtgagttcctcccacatcaataccgatatattgctgcatagtgttctccgtacgttaaacaggcacctgtttagtatggctaaaaccagacggagaaacgtaaaggaaagtaattcgtgattgctgtcgtaaagcgagaaaccattggcgaaaaattcaccagtaccgtctacccttgtggagtacctttacaataaggagttggtcatgacgaacaatcccccttcaacacgtattcagccaagtgaatacgggtacccactgaagttaaaagcccgctatgacaattttattggcggtgactgggttgcgcccgccgacggcgaatattatcaaaacctgacgccagtgaccggccagccgctatgtgaagtcgcttcctccggtaaaaaagatatcgatttagcgctcgacgccgcgcataaggcgaaagataagtgggcgcatacgtcagtacaagaccgtgccgctatcttgtttaagatcgccgatcggatggaacaaaacctcgaactgttggcgacagcggaaacttgggataacggtaaaccgattcgtgaaaccagtgccgccgacataccgctggcgatcgatcatttccgctatttcgcctcctgtatacgtgcgcaggagggcgggatcagcgaagttgatagcgaaaccgtggcctaccattttcacgaaccgcttggtgtcgtggggcagataatcccgtggaactttccgctgctgatggcaagctggaaaatggcgccagcgctggcggcaggtaactgcgtggtgcttaaaccggcacgcctgacgccgctttccgttttactgttaatggaagtcattggcgatctgttaccgccgggcgttgtcaacgtcgtgaacggcgcgggcggcgagattggcgaatatctggcgacctcaaaacgtatcgcgaaggtggcgtttaccggttcgacggaagtgggtcaacagatcatgcagtacgccacgcagaacattattccggtgacgctggagttaggcggcaagtcgcccaatatcttcttcgccgacgtgatggatgaggaagatgcgttctttgataaagcgctggagggatttgccctgtttgcctttaaccagggcgaggtgtgtacctgtccaagccgtgcgctggttcaggagtccatctatgagcgctttatggagcgcgctattcgccgggtggagagcattcgcagcgggaacccgctagatagcggtacacagatgggagcgcaggtctctcacggccagcttgagactatcctcaattatatcgatatcggtaaaaaagagggggccgatattctgaccggtgggcgacgcaaggaactggatggcgaacttaaagagggctattaccttgagcctaccattctgtttggtaagaataatatgcgcgtctttcaggaggagatctttggcccggtgctggcggtaaccacctttaaaaccatggagaaggcgctggaaatcgctaacgatacgcaatatggcctgggtgctggcgtctggagccgcaacggcaatctggcctataagatggggcgcggcattcaggccgggcgcgtatggaccaactgctatcacgcctatccggcacatgcggcgtttggcggctataagcagtcgggcatcgggcgcgaaacccataagatgatgctggaacactaccagcaaaccaagtgcctgttggtgagttattccgataagccgctggggctgttctgacgcaagaggtaatgcccgatggcgctgcgtttatcaggcctacaagaatttatcgcaatatactgatattgcaaatcttgtaggccggataaggcgcagccgccatccggcacagtattaccgctcgttaatccaaatccgcatttcgccctcgccacggttggcccagctaaaccacggaatgaatgttagcgtctgcggctgacgcgatgacggcgcgttatcgtagtgccacaacgcctgatgctgcgcatccgcggcgctttgcttctcgccttcggcctgaatcagcatcttatgcgcaaaaagccctttgccctcaaagacccggaactcactctctttcggtagccacagattatgcagttcttcgccgttatcggcctgctcaaggcaatagaccagcggcccgcgctgaatagcgaccttaccggcgacgtgacgcgccagcggattgccatacacgcggcgaaccggcatcggcagcgtcaggcttatcgtatcgccctcctgccaggttcgacggatatgcagataacctttgcgaatatcctgctccacttccagcccgttgagcgtcacttttgcctcagggcaccagtccggcagacgtagcgccagcgtgtgacgtaccggctgcacagaatcgatggcgatcttcacctgctcatgccacgggtagttcccgctgattcgcagtttgagcgcgccattttcaaccggtatttccatgctgttacccacgtacatattgatgtacagcgcatccgcacgcggcgtgtagatgtagtgaccaatggacgtgagtacgcgggcgatattcggtgggcagcaggcgcagccaaaccagcgctggcggatgggtttaacgtgatcgtagatatggttgaattttaacgattttggatgcacttccagcgggttgacgtagaagaaatgcttgccgtcgagcgccataccgccgaggacggtgttgtacagcgcgcgctccatcacgtcggcgtactggctatcggcttccatttccagcatccggcgggcgaacatcatcaggccgattgaagcgcagctttccgcatagaccgaatcattcggtaaatcgtaatcgctgctaaaggcttcgccgctgctttgtgaaccgatgcctccggtgatatacagctgacgctgcgccatatttttccacaggcgcaggcagtcctggcgtttgccttcatcgttgctcaggcgagcgagatgcgccacgccagtcatcagatagacaaaacgtaccgcgtggccgattgccgtctgctgctgcgaaattggcagatgcgcctggctgtaggctttgtctttgaccatccacgccgggccgtaggtatgccagtaagaggtttggccgcgtttttcgtactcttcgtcgtagaagtgcggttgggcgccgcgctgcccgataaagtaacttgccagcgtcatatagcgcggctgctctgttacctcatacagacgcatcagcgccagctcaatttccgggtggcccggataaccgtgcagctgattttcgccagggccgaaagtgctgtcgatatgatcggccagacgacaaacgacgtctagcagccgacgcttgccggtggcctgaaagaaggcgacgcccgcttcaatcagatgcccggcgcaataaagctcatggcactccgccaggttgctccagcgttcttgcggggcttttgccgtaaagtacgtattgagatagccatcgtcacactgcgcggcggccaccagttcaatcacctcatcggcggttttctcaagctctgggtcgggtttttggcacagtgaccaggcaaccgcttccagccatttcgccacgtcgctgtcctgaaagaccatgccgtaaaagtcgcccgtctgctggcctgcggcaatgcggaaattttcaatggcatggctgggttcagcctctggaatacgatcgtttaacgcatcccactggtaaggaataaccacatcgcgaaccagttgttgatactgtccgagtaacggatcgctgaccgtcagtttatgcagatcgacttccagtacgttcatttcgtgctccttaaggctgtagaggtcatagatattcctcgctgacggggtattttatggcagtaatttttattttcgcgttatgacctgattcattttgcccagatagcggtgagcgacaaggcgataaaagagtaaaaaaagatgacgattccgactcgtatttaaaaatgtgagatggatcgagtgaaatgactatttttagttaataatcaaaaagtaatatgaaatacggtgctgaatgagcgggaaataacatattaatgctcgaattatccataacattaccgattaaagtccaaaacggcggattatttatttctcgcggcattgggcgtcatcctgccaggcgtctgcaatcgtgggaaattatatttgtggaaaaaggctgcctgaaaattcaggaagaatgtgttttctgtgtcgaagccggggaaagcctgttgctttggccgcatcgccgccatattggcgttgaggagtttcccgccgatcttaaattttactggctccattttgaggtcaaagcgccggacagcgacccgcgctggctgacgcatctttccgtgccgcagcatacccaggttgccgatccgcaggcgctgattgcgctttttcgccagtttatgaacgagcaggaaaagcaccagcgcagtccggcgctggagttcatcgtgctgctgattttgcagcagctcaccgttgacgcccggcagaatgaaaacgccgaggccgctggcgtgtcgctggcctggaaagcgcagcagctgattcgaacgcactatcacctgccgctttccagcgcggttctggcgaaagaactgcattgcaatgtggattatctgggacgcgtttatcggcgggtatttcaccttacgctaacggaagccatccaccgccagcgggtgcgcgaggcggaaaagttgctgattagcgacgcgcgttcgttaaaagaggtggcggagcggtgcggttttaatgacgttggttactttcgccagatcttccgcaagcacaccggcctgacgcctaccgcctggaagcggcgctacagtaaggaacacgttaattcttgagtataatctttggccctctgacaacgcggttgcaaactgaatgcccgatggcgctttgcttatcgggcctacaagagttcatcacaacgtattgatattgcaaatcttgtaggtcggataaggcgcagccgccatccgacacaggctgtgactgccgatattactgcccgtaataggcgttcgcgccatgtttacgcagatagtgtttatcgagcaattccggctgcatatccggtagctgcggggccagctggcgcgagaacagccccatataggcgcactcctcaagcaccacggcgttgtggacggcatcggcggcatttttaccccaggcaaacgggccgtgtgaatgaactaataccgccgggatttgcgccggatcgagaccgcgctcttcaaaggttttaataatcacctcgccggtctgatactcgtactcgccgttaatttcctcaacggtcatcagccgggtacaggggatcgcgccatagaaatagtcggcgtgggtggtgccccaggcgggcagatcgagcccggcctgcgaccagatcgtcgcatggcgggaatgggtatgcacgatcccaccgatctgcggatagcggcgatagagcgccagatgggtcgcggtatcggacgacggttttttgttgccttcaacgaccttaccgctggcgatctctaccaccaccatatcgtcggcggtcatcacctcatattcgacgccggaaggcttaatgaccatcagcttgcgcgtctcatcgaccgcgctgacgttgccccaggtaaaggtgaccagcccgtgcgccgggagggccaggttggccgccagcacctcggctttcagttgctctaacatgtgaaacctccttcctgcatccgtgattcaatccagcggcgggcctggataatttccagcaccggctcgctggctttctctgtccacatctcaatcagaaatgaaccgcgatagttcagctcatgcagcgttttgaagatgctgacaaaatcaacgcatccttcgccaaacggcacgtcgcggaactggccggggttgtcaccggtcaccggcagcgtgtctttcaggtggatcgcggcgatacggtcgatacccagcttcagctcggcggtcacgtcgttcccccaggcgctgaggttgccgacgtctggataaacggtgaaccacggtgacgaaagcatctcgtcccactttttccacttgctgatggagttcataaacgcggtatccatgatctccaccgccagcatcacctgcgccgctgcggcctgttccaccgcccacgccagcccttcggcgaaacgttgctgggtgccttcgtcgtgctcttcgtaatagacgtcgtaacctgccaactggatggtgcggatccccaggtcgcgcgccaggcgaatggctttggtcatgatttcacgcgcccgctggcgtaccgcttcgtcgcggctgccaaaagggaagcgacgatgggcggagaggcacatcgacgggatggcgacgccgctttccagcatcgcgttcaccagcgaagcgcgttgggccgaggtccactccaggcgtgagagacgttcgtcggtttcatccaccgacatctcaacaaaatcaaaaccgcagctttttgccagcaccagccgctctggccaactgagatctttcgccagtgctttctcgtaaatacctaatggatgattacgcatgcttttctccccaaatggcgtcaatttgggcgtggaattcggcggcgacctgcgccggatgggcggcacctgccagcgcacgtccggcgataaatgccttaacgttaatgtcgcggaacagcggcagatccgctggggtaatgccgccggtaatcgatagttcaaggccgatgtcggacaacgccttcatacgcgccaggtccgcttctccccactgctgcccgctggcctgcgcatcgtgtccgcggtggtaaatcgcctggcgaaccccgacgcgataccagtctcgggcgtcgtccagcgtccagttgccgaacagttccatttgaatttcaccgccgcaggattgcgcgacggcatggcctttctcgacggtcgcgagcggcgcggcgcagatgatagtcatccagttagcgccagcgctaaaagcctgctgcgccagggtttcaccggcatcggccactttccagtcggcgacgatgattttttccgggcactgcgctcgcagggctttcaccgcgctaaggccttcggttaaacaaaggatggttccggcctcaacgatatcgacatgatcctgtagcagggcgacatcgcgctgggctgcttccagactggtgtggtcgagcgccagttgcagtaatggtcggctcataatgcgtgctccttaatacgggcgtgatagccctgtagtgcttcaatcaaatcctggtattggcggtatttgcgctggtagagggcgtgcgcggtcatgtccggcagcagcgtgcgtaccgggtgctgcaggtcgcgttgggcctcgtggaaatcgcgatatacgccggtgccgacgcgggctgccagcgccgcgccgaagcagccggtctcctccacctgcggcagctcgatgcgtaacccgctgacgtccgacagcatctgcatccagacgtcggagtgggccggtccgccggtaacgcgcagggcgcaaacctcggtaaagcgttcacgcatgcggttgaggtgggtcatatggctgaagaccacgccttcatagagcgcctgtagcaggtgcgcgcggttgtgcagcgcctgcatgccataaaagccgcaggtcatctccagcccggcattgctgccgtagagaaacgggagaaaaaaaaggtcgctaccggctttcggcaggctggcaaccgcctggttgatctcgtcaaaagagaggtagccccactgggcggtgaaccattcaaggttgccggaagaggtcgggctggcttcgtgaacgatatactgcccgtcattgacgtagcggccatagacgtaaggatgggcctcatggtcgcgcagaccgtgagcgatgccgctggtgacggcccaggtccccatcaccgcattgagcgttgattcatcctcaataccggcgcaaagggcggtggaaaccacgtcaaacaggccgccgacgacgggggtacccgccgccagaccggtgatagcggccgcctgagcggtgatctccccgcatatttcggctgaacccaccacggggggcagcgcgctatcgatttcactgatgcccagccattcggtcaggcgcgggtcgtactggcccgtcgccatgttgtagaggttggactcggagatattgctctcctcacagcctttcacgccggttaagcaccagcgcagatagtcatgcgtcatcatgacgctgcctatctgcgcgtagcgctgcggctcattctcttttacccagcgtaaaagggagaccggatgcccggtccacagggtttgccgggtcagtgggtagagtttttgcggaaccgcttctttttgccagcgctggacaatttccatggcgcgacgatcggaagagagtatcgctttacctaatggccgatcgcttttatctaacaggaacaggcctttcccttgggctgaaatacccagaccgcggatttgtgagccgctcacccccgtgtgcgtcagcagtttgctgatgaccgaagcgcactgttgccacagttcggtcatatcgcgttcaacccagcctggctgcgggcttaaagcgtgcagcggcaggcgttgcaccgctacttcccggcctgcgccatcgtacaacccggcttttagccaactcccaccacaatctaaccccagccagtaattgctcatgacttattgcacctcgtccacggctttcaggaggtcggcgccctgcgggttgtctttcaggaacatatcgcgcacctggctgcccagcgcatcactgaaggctttacggtcgatatcggtcaggacttcaactccggcttctttcatgccatcgataattttttgctgatcttcggcgaccagtttgcgctggtagtcccccgcttctttggcggaactcagcagtgcctcctggaactgcgggcttaaagcgtcgaatttggctttattgatcaccagcagcagaggcgaataggcgtgatgagtgagggagaggtatttctgtacctcatagaatttcgctgaccacacgacgttgatagggtgttcctgggcatcaatcgtacgggtttcgaggccggtatagacttcggagaatggcatcggaatagggttcgcgccgaagattttaaaggccgcgatattcattggactgttgttagtgcggatttttaagcctttcaaatcgcccggcgtttttaccggcgcgcgggagttggtgacgtcgcgccagccgttttcccagtaggcgaggacttttaacccttttgaatcgagtgattttttcagttcatcgccgactttaccgtcgagcgttttatgcgcatgcgaggtatcgcgaaacaggaaggggacatcaagtaagttgaatacaggggccaggccggtgaaattgttcgaaccggacatttccatatcaatagttccgccgcgcaccccgctgatcattgcctgagcgttacctaatgtgctgtcaggaaagagttttagcgttaattcgccgttggttttttcttttaataattcgttaaattttttcgcggcaatatgttgggagtcagtttgcggtgtttcataaccaaaacgtaaagattgcgccgccagagacgacacgctgaaaaccgtcagaccagctatcaataatgaacgagcaataacgtgtaatttcataatattatcctttaattaatccatttaagcggtgtgataattagctcgggaataaaaataaataaaaccagcagcgacatcagtacgacaacgtaagggaatacgcctcttaccgcgtcatcaaatttcaattttgctaccccggaaataacgttgaggacgttgccaacgggcggtgtgattaatccaatagagcagttaataatgaacatgacgccgaaataaatcgggtcaatattggcttctttaactaatggcaataatacaggggtaagaattaacaccgttggcgtcaaatccatcaccataccgacgaccataattgagatcataatgacgataaataagagtcgcggagagtcgaccagcggctgcagcaaatctgacactatcatgggtaattccgcgatcgtaatcagccaggcggatacctgggccgcggccaccagaaacatgacgactgacgtcgttttggcggcattgaccagcacgtggtagagactggaaaacgttaattcccgatagataaccacggcgacaaagagggcgtaaaacgcggcgaccgcccctgcctccgttggcgtgaaaagtccggaacggaagccgccgatgataatcaccggtaaaaacagcgcccagatacctgaaaccaatgaataccagatttcacgcggtgttgctttaggctgagaagggagatttaatcgcccggcctgccaccaccaggtgagcataagcgccgcgcccatcatgatgcccggtgcgatcccggccataaacagcttgctgatcgacaagccgctggaaacgccgaagataataaaaggaatcgaggggggaataattggcgcaatgatcccgccggaagcgattaacccaacggagcggttgatcgggtagtttgcggagcgcatcatcggcaccagcagcgcggcgaccgcagcggtatctgctaccgcagagccggaaaggctggccataatcattgccgcaataacgcccacgtagcccaggccgccgggcttatggccgaccagcttcatcggcaggtcgacaattcgctttgacaggccgcccgcgttcatgatttcaccggccaaaacaaaaaagggaatggccagtagggagaaactgtccgcgccgttaaccagggtttgcgccataatctgcacgtcaaacatatccaggtatgccatcagagcagcgccgcaaagcagcagcgaccaggcgatgggtaaacctatcgcgatcccgccgagcaggcagcagagaaatatcaccacggccatgattaggctccttgctgtggttgttgaaaggaatcgttacgcgttattaagtgataaagccgacgcagctcgattaacgcgatggcaacgcttgtgggcagacaggcgatatacatcaggccgatcggtaaaccgagaattggcgagtgatcgctccagtcctgcaacgctttttgcaggctgccccagcctaatgcgatgcataacaataaaatcagcgaatgtgtcagcagcgagagtcgacgctgattcgctggcgaaagtttttccaccacaaaagtgacctgaacgtgagcgttatccataaatgcaacgatggcgccaataaacgtcagccatacaaatagataacgtgatagttcatctaccgacaaaatactgctctcaaaaccgtaacgtaaaataacgttaataaatacaatgcaggaaagtacggcaattaataccgcaagtatgccctcaagtacccgcttcataacgactccatcaggttatagaaacttatttctttcgatgctgaatagtggaacttaatttcttatgtttggtttatattaggtcggcgcaacgttgagttgcaggccgagaattaaggtgatgatgtttaattcaggttagcggcgtgtggcctttttcatcatgttaataccatcgcgtaatatatttatgcggtgattaatatcggcactggcattgatttccaacaatttaataccggtaaactgcaacagttcgggagcggcggcggtaatcagttctttaacatgtttctccgtcatcagactttgtggacagaaaggtgcaaacggagcatggaggtcctgccattcgccgtattctccatccagcgttgtaccggagaacatcagcgccccgagttttccagcctgtttggcctgctgcgtgtggatcagcggtagagaggtatcccgcccttcaatagccgagcgcgcccagttaatgcagacgcttatgtcatagtcggcaatagtttccagtacgtttaccaacggtaagaatcctttgcgcggtgcggggccggtcatcgcgtcgcagtgttcaagcaccaggtcgcaggaccagtcccagttggcaatctcttttaatgagcgcgcaaaggcgtcggttgcctgcgccacgttcggattgcccgccagaggagcggcatgaagctcaagggctatgactttgccggtattgttcccattgattttattgatcttctgatgcagatgacgatagtactccacgcaggctttacgctgttcctcgtcactggacgctaatccaaaaccgccgttttcgctacggcgacgcatggtttccattatcgcggtgaccacgatttgccagtttcccggtgtatggcgcaataaccactcgtcgccgagcgggtgaagatgttcaagacaaggctgctccagcccccggatatccggagtatcagagagttgccgccagaattccgtctcttcctcttcactcttctggtgaaatgagggtgcacaagggtacgcaccgataatataaccggtattatttttcattttgtgctccagtaaactctattttataaaacgtctatggcgacttttacgactattttccgtatcggcgtagcaatgcttttattacaaccgggacgatgaacatcctgcgggaaaaacagggcataacttcccggtatcatttcaatgaatgattcatgttcactgtcgtgataaaaaataatatcgcgctgttctaataatgactcgctgatttgattattaccggtatcaatggcaaccccaattttctcttcaccccatgccagaaactgaatatccagatagcggcgatggacttccggacgattttcagcagcatcgcgggtggtcatatcgataatctgcgcgaaggtatttttgccgtcgatttccactacgccgggttccagcgtgcgaaagtcggtggtacgtaaaaagtgaagcgctttctcgatcgcggctggcaaatgacatggatttggctgcgcgatatgtccaaaaatcatgatgtggctccttacagcgcctggattttagcccagacgctgtcgtcaatggtgataccgttacagcggctgtcatccagcaatttggtaaattcgtggccgggcagccgaatcgcgacgttgtcgtcagcacgttcagcagtggtgatgaaatccataatccgctgcagtttggcatcgcgggttgcgccatcgatcagcttatccacttctatggcgatgaaaatctgcgaaacgccatactcatcgctgttttcctgggtcacttcggcaacggaagagccgttggaaagcagggtggcaatcatgtccagcacaatcgacagaccagatcctttccagtaacccatcggtaaaatgcggtgatttttctcgatcacgcccggttctttggtcaactgaccgttatcgtcgaaaccgccgtccaccggcagttcgcggcccgccagacggttaacttctaacatcccgtaggagaacatcgacatcgacatatctaccatcgtgatcggcgtagacgggatggcgacgatcagcggattggtaccgatacggcactctttcgcgccccacggcggcatgacggcgatggagttggtccagcaaatgccgatatagcctttttccgccgcctgccagccgtagctgccgccgcgcatccagtggttagcattacgtaacgccaccaggccaataccatgatcggaagccagctcgatggcccggtccatcatctttttcgccgtcaggttgccgatagcgcgctgagcatcccactgttcgatggcgccgaggctggtaacccgctgcggtttagcatcaggaataatgtcgccgttatccagttgctggatgaagcggggaaagcggttcacgccgtgggaatagacaccggactcggtggtgcgagcgaacatttccgcgcaggcgtcggcggtatcttccgcaatattccgcgaccgcaagacgcggtagaaggccccttttaactcttcgaaagttactttcatccctgttctcctggtcgattgttagaaattttagtatgtttttttgtcgataaatttcataatgcgaaatgtagttccaaatatatagatcaaaaattgacatggcaacgccagagaagctttttaaaaacgattaaaatcatcgggttatgttttttatgctgatatcgtgaactgcaacacactttgagctaccatctgatcgcccaagaaaggagagagttttctgatgagccagaacaacgataaagagaagcctgcggggagtcagagcctgtttcgtggcctgatgttgatagaaattttgagtaactacccgaacggttgcccactggcgcacctgtcggagctggcggggttgaacaagagtaccgtccatcgtttgttgcaggggcttcaatcctgcggatacgtgacgccagcgccggcggccggaagctaccgtctgacgacaaagtttattgccgtcggccaaaaagccctgtcatcgctgaatatcatccacgttgcggcaccgcaccttgaggcgctcaacctggccaccggcgagacggtgaatttttccagccgtgaagatgatcacgctatcctgatttataagctggaaccgaccaccggtatgctgcgcacgcgtgcctacattggccagcatatgccgctgtactgctcggcgatggggaaaatttatatggcgtttggtcagccggattatgtggcgtcttactgggaaagccataaagatcagatccagccgctgactcgtaataccattaccgatttaccagcaatgtacgatgagctggcgcaaattcgtgaaaccagcatggcgatggatcgcgaagaaaatgaactgggcgtttcctgtattgctgtgcctgtgtttgatattcaccatcgagtgccttacgccatttctatttcactgtcgacgtcacggctaaaacagatcggcgagaaaaatctgctcaaaccgttgcgtgaaaccgcacaggctatctctaatgagctgggatttaccgttcgcgaataagacagctcgccaggttttatcaggcatctgacaaaatttgtccgtttgcgtagtgggatcaaagcggcggggaatggctctctggcattctggcgttttaacgcagggggagaacaatgaaccggtttattatggcggatgcgtcggcgtgtatcgggtgtcgtacctgcgaggtcgcctgcgtggtgtcgcaccaggaacagcagaatagcgcggcggtgacgacggcggactttgtgccgcgtatccgggtgataaaagaggatagcttcaccacggccacggtctgccatcagtgtgaggacgcgccgtgcgcgaatgtctgcccggtacaggcgattcgccgtgatcgggggcatatcttcgtgacgccatcgcgctgcattggttgtaaaagctgtatgctggcttgcccgtttggcgcgatgactgtggtggcgtccgcgtcaggcgcgcaggcgattaaatgcgatctttgctggcatcgggaagcggggccggcgtgcgtggaagcctgcccgaccagtgcgttacagtgcgttgacgcaacacacgtgcagcgccagcgcctctattctcaacctttctgaacatcgttccggcctgcataatggccggaataaccgtcagccttcacgccaggcgcgttctatctcttctgccagaatttttacgcccgcctcgattttatccggttcaggcacgtagttcatccgcatacactggtgtgtgtgcggccagggtttatccagtccgggaaagaaatagtggcccggcaccatcagcacgccgcgcgctttcaagcgttgatagagtagctcggtggtaatcggcagatctttaaaccacagccacaaaaatattgcgccttctggtttatgaatcaggcagcgttcttcggataaatagcgacgaatgatcgcgatcgtctgttgaacgcgctgatagtagaaaggtttgataaccgtttccgacagccgcagcagatcgttacgcttaatcatttcgcacatcatcgccgggcccatgcccccgggcgcaaggctgatgatgccgttcatgttggcaatggcggtaatcgtcttatcattggcgatgataatcccgcagcgggaaccgggcagccccagctttgagaggctcatgcataggataatattggggttccacagcgggcgcgcctcgctaaagataatgcccggaaacggtacaccgtaagcgttatcaatcaccagtgggatgttgtgctgattcgccagtctgtccagcttcatcagctcttcgtcggtgataacgttaccggttgggttggtcgggcgcgagacgcaaatcatccccgtttcttcgccgatgtgcagatgctcaaaatcgacgtgatacttaaactggccttccggcagcagctcaatattcgggcgcgccgaaacgaagaggtcgtcttccagaccggaatccgcatagccgatgtattccggcgcaagcgggaatagtacctttttcgtactgccgtcggcgcgacgtccggcgaagagattaaataagtagaaaaacgcgctctgactgccatttgttagcgcaatattctgtggttcgatatcccatcccagcgtttcacgtagcagtacggccagtgcattcagtagcgccgtttttccctggggaccgtcataattacaaagcgcatcagcggctttgccgctttctaccatctctgtcagtagcgtctggaaataatcctgcattgcagggatgtgtgccgggttaccgccgccaagcatgatggcgcctggcgtgcgtaagccgtcgttgagatcctccatcaggcgggtaatgcctgaatggcgggtaaatttatcgccgaaaagtgaaaatgtcataacgggtgatctatcgaactgtctgtcaaagtggataaccataacgctacaaatggcggggcgcaaatgggggacaggcggtggtattgatgttttatgctacaaatttttatcagtttagttttttattttgaagaggttaccggtacgcgaggggaccggtagcgccacgattagcggcggcccgcccagacgaccatcaccgtatcgtcgccgtactggcgtacaaaaccgtacccgtgttttagcgtcagcgtggtttgttggcctgcgccgatggcgggatgtctggcgcggaactggctaatacgctgccagtgcgcgacggctgcggctgactttccgctcacgtcctgccagttcatatcagaacgggtgccttgcagcgggtcggagccggtggggccgaagggacgagcggattcatcgccgtaaaagatctgcaccgcgcctggcgaaagcagcagcagttccgccgccttatcaccgccctcacggaaaaggcgcgtatcatgcgaggagaggtaacttaatacgttgaaatcctgcattttatccgccatctgctgccagactggccccatttccgccaggcaatcgaccgctttcgccgcctgctcctgataatcaaaattgatcatcgcgtcgaaaccatagcgataataatcacttttcatgacgccgtggccccacgcttcgccagtcatccagaacgggctatcatccagcgctttgtccggattggcctgcttccattcatgtaacgccgcgctggcctgggtttttagctgttgccaggcaggaagctcaacgtttttggcagtatcgatccggaacccgtcaatgccgtaatcatgcacccactggcttaaccagtgagtcagataatcccgtggcgtatagccctcaatgaactttgctttagtatcgggtttgttggcatagaacacgggtaggccggaaggcgtggtagattccgtttttatatccggcaggaaggccagcgacagggttaaatcgtcaaatcccggactgtcgtagtcgccaatatcggtacgaatccactttttcccccaccatttttcccaggcggcgctgtcgctgaagttgatgtagtcgttaaagctgtgccagctttgtccggcggccggtcgccagtttgtccagcgatcgccgagaattttttgccgttccgcgccggataaatagagcgcgccgaactgatactcctgcatatccgccagcgtggcgtaaccggcatgattcattactacgtcaaataaaatacggatgccgcgctggtgcgcgccgtcgaccagcgcgcggagatcggcttcgctgcccatattggcatccagcgtcgtccagtcctgagtgtaatagccgtgataggcgtaatgaggaaaatcgccttttgttccgccgccgacccagccgtggatctgttcaaacggcgagcttatccacaaggcgttcacgcctaattgctgtagatagtccagttgactcgtcaacccgcgcaaatcgccgccgtggaaagtgccaatctcttgcataccatccttatggcgaccataactgtggtcgttggttggatcgccattgcgaaagcgatccgtaagcacaaaataaacggtggcgttgcgccagttaaaaggcgctgacgcatgggtttccgcgcgttccagcaataaaagcccgtggctgtcggcaggtagcagcgtgatttttccgttttggacggtatcgatttgaccactgtaataatcgcgcactaccgtcccttccggaaaggtttggcgaacatccagcgtgagcggcgaaccatcccagacgggacactggtaggcgagctgcgtggtgcgttcaggttcagtttttatcgataacaacagggtcggcgtaccggatcgggtatctaccgttatcgtatagtcgccatctttaaacagacgccattgcggcggcgcgccttcgcagggttttaacgacaacatttggttgagttttatagcgccggagggctgccagcactgctggtcaatatggagcgttaacgcgcgtgtaccttttgttaatgcagcatggctggtaaagcgtccggtttcctgcgtcgagagcgtcggaaaaccgggcgaggtccatgatgaggcgatcgcgataccgggtatcagcgtcagagcgaaggcggcaagtttcatcacgctatcctttgtgggcaatattcatcagcttgcctggtttttaggcgaatgaactcctccccagcagagagtcgcgcaggaggaggcgcgagggtgagcgacgaggcgcaaaaaaacgcctctatttgcgataaacgccgcattttattggcattattgctgtctgttatcgttaatagttgacatagtttcggattaagactattccctgaggtgctttttaagcctatttttgctagaatttggggttcaaacctcaacttcgtgaaaaataaaaggtgttggaatgtatcaatccgaccaggagacctaatgatattgactcccatgcgacgatatggggcaatgattcttatgttactcaccatcgcattttcgggtgaggtgctggcaaagacgcgcgcaacacaaacgagtcaaaagtcccacataactgagacaagttataaacaggttagcagtaaacaagagtattctcgcaatagtgcaaagagcagttcacttcctgatttgcgaaaatacccttccggaacccccagaaaaaaagcgtttctccggaccgttatgccttacatcaccagccaaaatgccgcgattaccgcggaccgtaattggctgatctcaaaacagtaccagaaccgctggtcgccgtctgagcgcgcgcgtatgaaagatatcgcgaagcgctataaagtgagctggtccggcaacacgcgtcgtattccgtggaatacgttgctggagcgcgtcgacattatcccaaccagcatggtggcgacgatggcggcggcggaaagcggctggggaacctctaaactggcgcgtagcaacaataacctgttcggcatgaagtgcacgaaagggcgttgtaccaatacgccgggtaaggtgaaaggttactcgcaattcgcgtcggttgaggagtcggtgagcgcgtatgtcgccaacctgaacacgcatccggcttattcttctttccgcaagtcgcgcgcccaactgcgtaaggcggatcaggaagtcaccgccacggcgatgattcataagctaaagggttactctacccagggggcgcgctataacaactacttgttcgcgatgtaccaggacaaccagcgtctgatcgccgcgcatatgtaattctgtgtgccggatggcgctacgctatccggcttacaaggcatctgtaggctggataaactacaacaacgcttcactatgctggtcgcgatactccttaggcgtagtgacgtactcctttttaaacaccgaatagaaatattgcagcgacgggtagccgcacatttgcgaaatttcgtttatcgccaacgtggtggaaatcaacaaactacgcgctttttccagcttttcggcgtggatcagcgcatgtatcgtctcgccaacttcttccttaaaacgtttttccaggtttgaacgtgaaatcccaaccgcgtccagcacctgctcgactttaatgcccttacaggcatggttacgaataaagtgcatcgcctggataaccgccggatcggtcagggagcgatagtctgtcgagcggcgcgcaatgacgcgcaccggcggcaccagaatgcgctgtaacggcatctcttcgcgcgccagcaaacggtgcagcagcttcgccgcctgatagcccatttgccgcgccccctgcgcgacggaggaaagcgcgacgcgcgacagataacgggttaactcttcgttatcaataccgataacgcaaagtttttccggcaccggaatatgcaggtgttcgcaggcctgcaatacgtgacgggcgcgggcatccgttacggcaatgatgccggtttgcggcggcagcgtctgaagccagtcggcgaggcgattttgcgcgtgctgccagttttccggcgcggtttccagcccctgatagactacgccgcggtatttttcctcggcgaccagctggcgaaaggcgtattcccgttccgccgcccaatgtttgcggctggagtcgggcaaaccgtaaaacgcgaagcggttaacgcctttttcttttaaatgcaggaaagcgctttcaacgagcgcatgattatcggtggcgatgtaatgaacggcgggataattttcagcaagatggtaagaaccgccgaccccgacaatgggtacgtcgacatcggccaataattgcgcgatatcgtcatcatcgtaatcggcaataacgccgtcgcctaaccactctttaatgttatcgatacgggcacggaaatcttcctcaataaatatatcccattcggattgcgaggcttgtaaatattcacccaccccctccactacctgacggtcataggctttattcgcgttaaataacagagtgatacggtgacgtttatcaaacatgaggatatatcctgcaaaagtgaacctggactcatggatactatcaaaacggctgacataacggtctggcgaatgatgacaaattattttgcgcctgaaacgttatgcgaaattcatcacagcaaacggcggatgacaattgtcatttcttatctatatattacggttttttgtttatttgccaggattcgatcgcgatcgcttttttcttctgtggttttcagcgtttttttgagagccagagcacatttggggattctcttaatagcggtgtgaaataacgtaattgagcaataaatcaggaaattccagtatgacgttatgtcgtttacttgccgtcttatctgattatggagctcactatgcaggcttattttgaccaactcgatcgtgttcgctatgaaggccctcaatcgactaacccgctggcatttcgtcattacaatcccgacgagctggttttaggtaaacgtatggaagatcacctgcgtttcgcggcctgttactggcataccttctgctggaacggcgcggatatgtttggcgtaggcgcgtttaatcgtccgtggcagcaaccgggcgaagcgctggagctggcgaaacgcaaagcggacgtggcgtttgaatttttccacaaactgaatgtgcctttttactgcttccatgacgtggatgtgtcgccgaaaggcgcgtcgttgaaagaatataaaaacaacttcgcgcagatggtggatgtgctggcggcgaaacaggagcagagcggcgtaaaactgctgtggggaacggcgaactgctttaccaacccgcgctatggcgcaggcgccgccactaacccggacccggaagtctttagctgtgcagcgacgcaagtggttacggcaatgaacgccacgcataaactgggcggcgaaaattacgtactgtggggcggacgcgaaggttatgaaacgttgctgaataccgatctacgccaggaacgcgaacagattggccgctttatgcaaatggtggttgagcacaaacataaaatgggtttccagggcacgctgctgattgaaccgaaaccgcaggaaccgacaaaacatcagtatgattatgacgttgcaacggtctatggcttcctcaaacagttcggcctggaaaaagagatcaaagtgaacattgaggcgaaccacgccacgctggcgggccattcgttccaccatgaaatcgcaaccgctatcgcgctgggtatttttggctccgttgatgccaaccgcggcgatgcgcaactgggctgggataccgatcagttcccgattagcgttgaagagaacgcgctggtgatgtacgaaatcctgaaagcgggcggattcacgacgggcggtctcaacttcgacgccaaagttcgtcgccagagcaccgataaatacgatctgttctacggtcatatcggcgcgatggatacgatggcgttgtcactgaaaatcgccgcgcgtatggtcgaagacggcgagttggataaacgcgtggcgaagcgctatgccggctggaatggcgagctggggcagcagattctgaaaggacaactctccttaggcgaactggcgcagtatgcggagcagcaccatctggcgccggtacatcaaagcggtcatcaggagctgttagaaaatctggttaaccgttatctgtttgataaataactctatctaccgggcgactccgcgttagcccggcctgtagtcgtgattagcccggtaagcgtagcgctgccgggcgctttcagtaaaggaacccacactatgtatatcgggatcgatcttggtacatcgggtgtaaaagctatcctgttgaatgagcagggcgatgtgctggctacgcatactgaaaaactgaccgtatcgcgtccgcatcccttatggtcggaacaggaaccagagcagtggtggcaggcgacggatcgtgcggttaaaggtttaggtcggcaacagtcgttaagtggcgtccgggcgttgggcatcgccggacaaatgcatggcgcgacattacttgatagccgtcagcaggttctgcgaccagcgattttatggaatgacggacgctgtagcgaagagtgcgcctggctggaaaaacaggtgccgcagtcgcgagcgataaccggtaatctgatgatgcccggttttaccgcgcccaaattagtttgggtgcagcgccacgaaccggatattttctaccagatagacaaggttctgctgccgaaagattttctgcggctgcgaatgacaggcgtctttgccagcgatatgtcggatgcggcgggaacgatgtggctggacgtgaaaaagcgcgactggagcgacgttatgctcaacgcctgtcatttaacccgacagcagatgccagcgttatttgaaggtagtgacattaccggaacgttgctgccagaggtcgccagcgcatggggaatgccagcagtacctgtggtggcaggcggcggcgacaatgcggctggcgcggtcggcgtaggaatgatcgatgccggacaggcgatgctctcactcggaacatcgggcgtctattttgccgtcagcgacggctttctgagtaaaccggagagcgcagtacacagtttttgccatgcgctgccggaacgctggcatttaatgtctgtgatgttgagcgccgcctcttgtctggactgggcggctaaactcaccgggcaggagaacgtcccggcgctgattgccgccgcacagcaggcggatgagcatgccgattcgatctggtttttgccgtacctgtccggcgagcgcacgccgcataataatccgcaggcaaaaggcgttttctttggtttaacccatcagcatggcccggcggaactggcgcgggcggtactggaaggcgtgggatatgctttggcggacggtatggatgtggttcacgcctgcggcgtcaaacccgccagcgtgacgcttatcggcggcggagcgcgcagcgaatactggcgtcagatgctatctgatattagcgggctacagcttgattatcgtactggcggcgatgtagggccagcgctgggcgcggcgcgtctggcgcaaattgcggtgaataaacagactccgctcgccgatgtattgccgcagttgccgctggagcaggcgcattatcctgatgcgcagcgtcatgcggtttatcaacaacgtcgtgaaaccttccgtcgactctatcagcagctgttgccgttgatgtcataagtcagaatgcctttcagttttggctgaaaggcatttcccgtaaatattgattctattgaattatatcgaagtaagtatgtgtgttttctgatttttatattattgctgagcaggcgcctttttcatcgctatttcttcgcttaatgtgtctcactcaaccacaaggagagtgagatggacgatcacgttgcacgcaggaaacggatattcggcctgggaatgttagttgtcggtgcagtggtatacttggtgggattgtggccaggctgtcatacattaagcgaaaagggatatttttttgcggcaatcgtcatgtgcggttttccagtcttaattcgccaggaacacacggggaatgaccgcttgctttctcgttgtaaatctttgctgttgcttggcatcggcatggtcgcggtcggcgtatttaacctggcgctggcgggcgcgctgaaaatactgtgtctggtggcgctgggggtcagtatatatggaaccgatctttacgcttcctacagtgatgatgaatgatggccggagccatcattgtcgtttagctaacccatttccgtttatcaatacgctgtaacagcatggaaagtagcaggcttcctgtcaccgtcgcggcaaaaacccacacgatgtctaacggcggccaacgttttaattccagaccattagtacgtagcgcatggataatcagcgcgtggaaaccataaatacccagcgagtggcgggagataagccccagtctaggtaacgtccgcgcattcagcttatttttaactaccgtgaacagtgagacggcgcaaataaacaccatgggaccgcaatacagataccaggtatcggcaaaatttccgcgccagcgtaattcatgcaatgtgccgcgagaaataacaaataccgcgatgatgaacagggcagcgcagataagcgtcagcgatggcttttgcgtctccatcattccaatggcgcggcccaggataccgtagagaatgtagtagaacgtgtcgccgctgatatacagattgatgggcaaccattcaacgccgccgattttttgcggcacagtatttgggttagcaataataccaatgatcaccatcagcatcaggagcattttgccgctcacgttttttacctggattaatggcgataccaggtagatcaccgtaatcgcaaagaaaaaccacaggtggtaaaacacgggtttttgcagcgcattttttagcgaaagctcgacgttgatcgaagtaaaaagtgaaatgtaagccagggcgacaacgctgtaaaagataaggcacagggcaatacgtaaaaaatgccgcggttgcgcgcagcgctcgccaaaaaaagatagcctgaaatcataaaaaacaggggaacgctaacgcgcgaagccgaattcaggacattcgcaatatcccagtttagcgggctgacgctgtgggcgttggtgatgtaccacgttgtagtatggatcatcactaccattaaacaggcgatccctcgcaggttatcaatccagttaattttaggctgcatcagttcctcagcttccgtttcaatagagttccagcgcggtggctcactggaaaaatccgactttctacgctacatcttgtgatggcgtaaggagattcgcacaatgtttctgttacccacaaaccttaataataagactgaccagcaaaccagacggtaataaaaatgataatgaagtatttctgtactgtgatgatagccatcgctctggtgggatgcacagcgacaccgccaccgacgcaaaaagcccagcagagtaaagtgagcccaacacgcacgctggatatggaagcattgtgtaaagctcaggcggcgcagcgttacaacactggcgcacagaaaattgctgttaccggcttcgaacagtttcaggggagctatgagatgcgtggtaataccttccgtaaagagagttttgtctgctcttttgatgcagatgggcagtttttacatctttctatgcggtaaaagccgcgcctggtgaggtgtgatgccgcgaaatccggtaattttcgctaaacaaaccggtttcatactgtatatctcgcatccagcgggtatactggctccttcctttaaatccacacgtatccagcacgaaataatatgcaaaagtttgataccaggaccttccagggcttgatcctgaccttacaggattactgggctcgccagggctgtaccattgttcaaccattggacatggaagtcggcgcgggaacttctcatccaatgacctgcctgcgcgcgctggggccagagccgatggcgactgcctatgtgcagccttctcgtcgtccgaccgatggccgctacggcgaaaacccgaaccgcttacagcactactatcagttccaggtagtgattaagccgtctccggagaatattcaggagctgtacctcggttctctgaaagagctgggtatggacccgaccattcacgacatccgtttcgtggaagataactgggagaacccgacgctgggtgcctggggactcggctgggaagtgtggctgaatggcatggaagtgacgcagttcacctacttccagcaggtcggcggcctggagtgcaagctggtgaccggtgaaatcacctacggtctggaacgtctggcgatgtatatccagggcgtggacagcgtttacgacctggtctggagcgatggcccgctgggtaaaactacctacggcgacgtgttccatcaaaacgaagttgagcaatccacctataactttgaatacgccgatgtggatttcttattcacctgcttcgagcagtatgagaaagaagcccagcagctactagcactggaaaacccgctgccgctgccggcctacgagcgtattctgaaagccgcccacagcttcaacctgctggatgcgcgtaaagccatctccgtcaccgagcgtcagcgttacattttgcgcattcgcaccctgacaaaagcagtggcagaagcatactacgcttcccgtgaagccctcggcttcccgatgtgcaacaaagataagtaagaggcggctatgtctgagaaaacttttctggtggaaatcggcactgaagagctgccaccaaaagcactgcgcagcctggctgagtcctttgctgcgaactttactgcggagctggataacgctggcctcgcacacggcaccgttcaatggtttgctgctccgcgtcgtctggcgctgaaagtagctaacctggcggaagcgcaaccggatcgtgaaatcgaaaaacgcggcccggcgattgcccaggcgttcgatgctgaaggcaaaccgagcaaagcagcagaaggctgggcgcgtggttgcggtattaccgttgaccaggctgagcgtctgactaccgataaaggcgaatggctgctgtatcgcgcctacgtgaagggcgaaagtaccgaagcactgctgccgaatatggtcgcgacctctctggcgaagctaccgatcccgaaactgatgcgctggggtgcaagcgacgtacacttcgtgcgtccggttcacaccgtaaccctgctgctgggcgacaaagtcattccggctactattctgggcattcagtccgatcgcgtgattcgcggccatcgttttatgggcgagccggaattcactattgacaatgccgatcagtatccggaaatactgcgcgagcgcgggaaagtcatcgccgattacgaagaacgtaaggcgaagattaaagccgatgccgaagaagccgcgcgtaagatcggcggtaacgctgacttaagcgaaagtttgctggaagaagtggcttcgctagtggagtggccggtcgtactgaccgcgaaatttgaagagaaattcctcgctgtgccgtctgaagcgctggtttacaccatgaaaggtgaccagaaatacttcccggtgtatgcgaacgacggcaaactgctgccgaactttatcttcgttgccaacattgaatcgaaagatccacagcaaattatctctggtaacgagaaagtcgttcgtccacgtctggcagatgccgagttcttcttcaacaccgaccgtaaaaaacgtctggaagataacctgccgcgcctgcaaaccgtgctgttccagcaacagctgggtacgctgcgcgacaaaactgatcgcatccaggctctggctggctggattgctgaacagattggtgctgacgttaatcacgctacccgtgcgggcctgctgtctaagtgtgacctgatgaccaacatggtcttcgagttcaccgacacccagggcgttatggggatgcactacgcgcgtcacgatggcgaagcggaagatgtcgcggtggcgttgaacgagcagtatcagccgcgttttgctggtgatgacctgccgtccaacccagtggcttgtgcgctggcgattgctgacaagatggataccctggcgggtatcttcggtatcggtcagcatccgaaaggtgacaaagacccatttgcgctgcgtcgtgccgcacttggcgtgctgcgtattatcgttgagaagaacctcaaccttgatctgcaaacgctgaccgaagaagccgtgcgtctgtatggcgataagctgactaacgccagcgtggttgatgatgtcatcgactttatgctgggccgtttccgcgcatggtatcaggacgaaggttactccgtcgacaccatccaggctgtactggcgcgtcgtccgacccgtccggcagattttgatgcccgcatgaaggcggtgtctcatttccgcaccctggaagaagcctctgcgctggcggcggcgaacaagcgcgtctccaacatcctggcgaaagccactgagccgctgaacgatatcgtccacgcctccgtactgaaagaagcggcggaaattgagttggccagacatctggttgtgctgcgtgataagcttcagccgtactttgccgatggtcgttatcaggaagcgttgattgagctggcggcactgcgcgcgccggtggatgaattcttcgaaaatgtcatggtgaacgcggaagagaaagatatccgtatcaaccgcctgacgctgttgtcgaaactacgcgaactgttcctgcaggttgcggatatttcgttactgcaataagcgttcagttaaataaacaaaaacctgctctcgggcaggtttttttataacataaatagtattagttgattcgctaataattctgtaactcatagacgcggttatctctattgattggcaagaattatttcaggaatacattaacgctggcggtacggatattggcgttagaatagctgcgggtgcttgagactgtttgtctcaggtattcaccaaaaggcagacagagaaaatccccacctgactatacccaaaataattcgagttgcttaaaggcggcaagggagtgagtccccaggagcatagataacgatgtgactggggtgagcgagcgtagccaacacataagcaacttgaagtatgaagggtatataaatcaaaagtgcactgcgcccattattgatctcttcaataacgaagcgatctcctgcagtatttcagaacgtccaactatgccgatgatcgatgacatgctcatgaaggcatttgccagacttgatgcgggtaccaatccggttcttcattcagatcagggctggcaataccgtcattgatggtaccagtatcagttacgagagtttggcatcatccaaagtatgtcccgcaaaggcaactgccttgataatgcctgtgcagaattttttttcggcactttaaaatcagaaagtttttacaccagtaaatttaaggatattgatgaacttaagatagctattgaggattacatacgatactacaatacccgacgaattagccttagatttaacggactcagcccggttgaataccgcctaaagagctatccaggcagaaattaacaaggtctgtacagggatgctatcaggaaacctgaacgttggtggatacgctcacgtaaatgtctgctatgagcgaggagcggacgccctatttcacaaaaattagtattgttctacaagtaactctcacaatgaggttttatgaaaatcagaaggttcagtaatggggatgaaatatcgttattcagagtttttttctcatctgtacatacgatcgcatcacactactacacacgtgaacaaattgatgcttgggccccagcagatatcgacctggagcgatgggccaatcacattaaggaattacaaccttttgttgtagagctggatggtgaaatagctggatatgcagatgttcaaccaaatggatacattgatcatttctttgtatcaggaacctattcaagacagggggtagggacactactgatgaattgcattcatgaggaagccagacagcgtggaattagtgaacttacttcaaatgtaagtaaggctgcggaagtgttctttctacgacacggctttcatatagtggagcgaggctttcctatttgccgtggagtgacattacaaaatgctctgatgagaaaatgtttggcgaaataatagtcagcctgcagaaaggcagcattgttcttttgccttgttgaactcagtaaaccgctacaatgagcaacgtccgctgctggcgcaaagcggacatcagtattcaaaaaatgaaaaacgacgacttgatgtatatcgtttgctatacatggtggttgtgctattcttgtaaagcaaatgctatacaaggggtgtctcatgaaatcagatgttcaacttaaccttagagctaaggagtcgcagcgggcgctcattgatgcagctgcggaaatccttcacaagtcacgtacagatttcattctggaaacggcctgccgggctgccgagaatgtgatccttgaccgccgtgtatttaactttaacgatgagcaatatgaggagttcatcaatctgcttgatgcaccggtcgcagatgatcccgttatcgaaaaactgctggcaaggaaacctcagtgggacgtgtaacagcaccagaacctttgtccgcttttcatcaggtagctgagttcgtcagcggtgaagctgtgctcgatgactggttgaagcaaaagggcctcaaaaaccaggctctcggagcggccagaacatttgtggtgtgcaagaaagacacgaagcaagtagccggtttttactctctggccaccggtagcgtcaaccatacagaagcgacaggcaaccttcggcgtaacatgccagatcccatccctgtcattatacttgcccgtcttgctgtcgatctctcattccatggaaaagggcttggggctgatttacttcatgatgcagtgcttcgttgctatcgggttgccgagaatattggtgtacgtgcaatcatggttcatgcacttaccgaagacgccaaaaatttctacattcaccatggtttcaaatcatcacaaactcagcagcgaacattgttccttaggctccctcaatagaatgcaaagactgttatgttcaaatcgctataagcgataatttgatagaacgtctaaggttaaattcaggaagaatacgacgaacaaaatattgatgagacaggaatccgcgtgatgcaagaaagcaacggaatggataatccgattgcggacaatgttatttagttatagccagaaacaaaaaagagcccatgtattaaatggactctttcgctgatgcctcggttaatctgtccaggttttggggtcagtacaaagtgagcccacctctgccattcttgtggcgttatgcattctcaaggcactctgttaattttatcttgttggcgttttataggcccgataacccattatgttatcgggcatttttttaacgtaatggtaattccgtcagacaggtctggctgtcatctctggtggcaatggcatgtgacgccgttttaccgttgtagcttacttcgagcgtcccttccatattgcgcggtagccaaacaccgataaatccgtttcgatagctttgcatctctttttgtacgatgacagcgcctttactgtctgtcacttttacagtgaacggtttattcggcatttctccctgacagccggaaaggctgtggttaaaacaggggtgtgtccgccattcatagggcgcaaaagagagatagaatttgtcgcctaacggtagcgtataaatctgctctccgtcagataatttgagctcggtactggtaatcgacgcggagtaaggcaaaggacggctctgcggcgtctgatcaatcgtatccacgatctgctcaaccgtttttcccgccagcccatgttgcgccagaaaagcggattctgaggatgccgcaagcgcggagccgctggcgcataaacccaaaagtaataaccatgatgatttcgacataacttcaattccttgtgaacaatctccttgcctactataggggttcccctaagggaaaggtcaaagggacgcagggtaaagtaatgcaaagttatgctggggggggagatggggaattggaataaaaaaaatccccgccatcaggcagggattcaaaattctgagctttttaagcttacaggctggttacgttgccagctgccgggcctttagcgccgctttcgatggtgaaggaaactttctgaccttcgtccagagatttgtaaccatcgttctgaatagcggagaagtgtacgaacacgtctttagaaccgtcatcaggagtaataaagccgaagcctttatcagcgttgaaccattttacgataccagtcattttaccggacatagtgtattaccttttaaaaaataagtgtgcctttcggcgttatggcgtgctttacagattttttaagcgttaaggaaatgcgcactacgaggggtatctaatggataactcttgaagggacttgccttactaaactgctttaatggtctgtacgtcaaaccgttgagcacattaactcatgtaatgccgggcgatgcaacttttattttactttatttctccaggccagtaatcgggcgggggaaacggcccttacgcaggaccgttaaaacagaaaggggtaaaaattgctccatcaattgcttacttaagcgtgggttcgcctgtatcaggcgcatcaatttgagctctgctggcgtgggtttttcgcgtttcgattcccattcctgaaccatggcaaccgttacgcccagcgctctggcgaattcatctgtttttagtcccgttcctctccgtaactgttcaaattcggtaaaaggattgggtttttgcgtcagggtgatctttcgtgtttcatctttaaaaacaatttgttccaggctgctcagcagctcaaacatcggatctttatattccattgagaactcctgtaaatcacacagcgggatcgtgaaatgcatcgaagcctcttaagaatagtcgggaaacttgcgggtggggggcgacgcgccgccaggaagcgctatcgattcgtttcgatgccttacgctacgcgacttttaggacgctaacaatttgatccaggaagatatatccgtctttcagaaaataattgtaaagattaaaaaaatattacatcccccgctggaaagctttcttgccgcgttttttatcgcagtgtcaggttaaaaattaacaataaaataataaattaagcattgatgcagataaacataattttccgctacaagatcgcgtggaaagggtatcctgcaagcctgacctggactatccttgtaagccgtcaggcacgcaggtgtcgttgtgcgcatttttgggtgaaaggagtattaacaatggcgacaggtaagtcctgctctcgctggtttgcgcctgttgtggcgttattaatggtgtttagcctgagcgggtgttttgataaagaaggcgatcagcgcaaagcgtttgtcgatttcctgcagaatacagcaatgcgtagcggagagcgtttaccaacgctgacggccgatcagaaaaagcagtttggtccgttcgtgtctgattacgcgatactgtatggctactcgcagcaggtaaaccaggcgatggattccggtctgcgcccggtggtcgatagcgttaacgccatccgcgttccgcaggattatatgacgcaacgcgagccgctgcggcaggcaaatggttcgttaggcgtgctggcgcaacagttgcagaatgcaaaactgcaggctgatgccgcgcatggcgcgttaaagcaggccgatgacctgaaacctgtgtttgatcaggtctacaaaaaagtggtcaccgtgccggcagatgctttgcagccgctgatcccggcggcgcagatctttacgcagcagttggtacaagtgggcgattatattgcgcaacagggcgagcaggtgagctttgtcgcgaacggcattcagttcccgacctcacagcaggccagccaatataatgcgctgattgggccgttggcctcgcagcatcaggcgtttaatcaggcctggacggcggcggtaaacgcgacccagtaatgacagtctgcccgataagcgcaagccagcgcttatcgggcctgtagcgttatcccgccgcttgcggattgacgcagttcttctctatttttccctgcagcgcatcaatcaaattatccaccgcacaggccatcatgttgtagcgcgtctcatgcgttgccgagccaatatgcggcaccgcgacgacattagacatgttcagcaggggcgaatccacagatagcggttcctgttcaaagacatccagacctgccgcatatatttcaccgttttgcagcgcggcaatcagcgcgttttcatcgaccaccgggccgcgtccggcattaataaaaatggcggacgatttcattctggcaaactgtgttgcgccaaacagatgtcgcgtttctgccgttagtggcaggatcacgcagacaaaatcggcctcctgcaacaacgtatccagatcgcagtagcgggcgttaaaccggtcttccgcctcctgatgccgccgacgggcgtgatagagaaccggcatggtaaacccaaagtgcgctcgctgcgccagcgccatcccgatacgccccatcccaacgataccgagtgttttgtgatgcacatcgacgccaaaccatgccgggccaatgctttctgtccattcacccgccttaacccgttctgcgacgtccaccacgcggcgggcagtggccagcatcaacgccatcaccgtatcggcaacggtttccgtcaaaacggcaggcgtgtgcatcaggactattttgcgggcagtaagggcgtccacctcgacattatcgtatcccaccgagatggtcgacgccgcgcgtagcgccggcattttttccagcagcgcgcggttaacggtttcgctggtgcccagaaggccttgcgcgctggcaaatgcctgcgcgtgtcgcgcgaccgtttccggatgcaggttcggtacctgggtgacggtaaaatgcgcctccaggcgatgcagcaaatcatcaggcagggttttgtagagaatgatggacggcttcatgcgactctccgtaaatcaaaaggtaagcgcggcatgcgccaaccggaacaggcttattattaacccgtttagccatcatcgaccagccgatttccccgctgtcggcagccgtgtcgtggtaaatagtgaatgaatactgaataatgcgacgtgtatccggtctggcgagggaataatgcaggccgggtaaagcatgccgccttacccggtacggtagtttactgcaatggactcaaggtaatttcgacgcggcggttttgcgccttaccttctgccgtactgttgctggcgatcgggttcgccggacccattccgctggtacggatacggctggcgtcgacgccctgggtgatcagcgaactggcgacggagtcagcacgctgctgcgacagacgcatattcagatcgtggctaccggtactgtcggtgtagcccaccacattgacggcggtcttgggatactctttcagcaccatcgccacgccggtcagcgtgttagcgcctgccggtttcagcgtcgcgctgctgctgtcgaaggtgacattattcggcatattcagaatgatattatcgccgcttcgcgtcacgctaacgcctgtgccccgcattttgtcacgcagtttcgcttcctgtacgtccatgtagtaacccacgccgccgcccagcgccgcgccagccgccgcgccaatcagcgcgcctttaccgcgatcttttttggaggaggagagcgcgccgatgcctgcgccgaccagcgatccaatacccgcgccaatgccggatttacctgcttcgcgttcgccggtgtaagggtttgttgtgcagccagatactgccagggcgccgctcacgatggcagcaatcacaaatacacgttttttcatcttaaatccttatcacttttttatttttaccacagcgaccgtggcggttgattatgacgtctgcacatgaagaaaattccagggaaaactctgaaatttgtaagtaacattgatcggcaaaataaataatcccaataattcaggagcgaaccttgacccacgcaccatcgcgtcattcggtattgaccgccgcacactgggggccagtccgtgttgaaaccgacggagaacgcatttttgcttcatatggcgaactcccgacggcacaccagaactccctgcaaaccgttgtgcatgaccaggtacacagcaaaacgcgggttcgcttcccgatggtgcgtaaagggttcctggcttctcccgataagccgcaaggcatacgcgggcaggatgagtttgttcgcgtaagttgggatgacgcgctggatctgatccacgctcagcacaaacgtattcgtgaaagttatggaccatcgtccatcttcgccggctcctacggttggcgttcgaacggcgtattgcataaagcggctacgctattgcagcgttacatggcgctggcgggagggtataccggccatcttggcgattattccaccggcgcggcgcaggctatcatgccttatgtggtgggtggtaacgaggtttaccagcagcagactagctggccggtggtgctggaacatagcgaggtggtggtgctctggagcgcgaacccgctgaatactctgaaaattgcctggaacgcctcggatgaacaggggctcgactattttgcggcgctgcgacaaagcggcaaacgcctgatctgcatcgatccgatgcgatcggaaagcgtcgacttttttggcgataagatggagtggatcgccccacatatgggcaccgatgtggcgttaatgctggggatcgctcatacgctggtggaaaacggttggcaggatgaagcgttccttgcccgctgcacgacgggctatgaccgcttcgctgactatcttttgggcacgaccgacggtacggccaaaacagcggaatgggcggcggaaatttgcggcgtttctgcggtgaaaatccgcgaactggcggaaatatttcatcataacaccaccatgttgatggctggttggggaatgcagcgtcagcagttcggcgagcaaaagcactggatgatcgttacgctggccgcaatgctggggcaaattggtacgcctggcggcgggtttggtttttcttatcattttgctaacggcggaaacccgacgcgccgcgccgccgtgttagcgtcgatacaggggagcatccctggcggggtcgatgcggtagataaaataccggtggcgcgtattgtcgaggcgctggaaaaccccggtgggttttaccaacacaatgggatggatcgccgcttcccggatattcgttttatctggtgggcgggtggcgcgaactttacccatcatcaggataccaaccgtctgattcgtgcgtggcaaaaaccggaactggtcgttatctcggaatgtttctggacggccgccgcgaaacacgcggatatcgttctgcccgcgaccaccagctatgagcgtaacgatttaaccatgaccggcgactatagcaatcagcatttggcgccgatgaagcaggtcgtgtcgccccggtgggaggcgcggaatgattttgacgtttttgctgaactgagcgaacggtgggaagccggcggttatgctcggttcaccgaaggaaaaagcgagctggcgtggctggagaccttctacaatattgccgcccagcgtggcgccagccagggggtgacgctgccgccgtttgccgcattctggcaggctaaccgtttactggagatgccggaaaatcccgccaacgcgcagtttgtgcgcttcgcggattttcgccgcgatcctgataaccatccgctaaaaacggccagcggcaaaatcgaaatctattctgcgcgcattgccagctatggttatgcggattgtcccggtcatccgatgtggctggcgccggatgagtggcacgggaacgccgatgcggggcaggttcagctactttccgcgcatccggcgcaccgtctgcatagccagctcaactacagttcgttacgggagcggtatgcggtagccggacgcgaaccggtaacgattcatccgcaggatgcgacaacacgcggaatcgtcgatggcgatacggtacgcgtctggaatcatcgcgggcaggttctggcgggcgcggtcgttaccgacggaattcggcctggcgttatctgtattcacgaaggcgcatggccggaccctgaacctaccgcaggcggcatatgcaaaaacggcgcggtaaacgtcctgacaaaagatcttcccagttcccggctggggaacggttgtgcgggcaacaccgcgctggtctggtttgagaaatataccggcccggcgctaccgcttacggcgtttgatccgcctgccaactcataatccaggtggggtgggaggtatcctcctgccaggcgctatcttcaatacgaaaaccgagcgcatggtagaagtttacggcggattgatttttctggtaaacctcaaggctcagcagaggaaaacgttgctggacatattccagaagcgctttgccaatgccgtgtcttaacgcgtcgggggcgacaaacagcgccccgacaaaacgggcttccagtacgctgacgaagcctttcagttgcccattttcctcccatacccaggtttgcgcggcgggtaaatagacgtcgcgtacaattgcttcgctctcgtgccagtaacgttcttcgataaagggatgggcataaatggtacttttcatccacagcgccagaatagacgccatgtcttcactctgggatttgcgaatcatgtttttctcccggatggcaaaaacagccggtaatatggtcgttgaccagtccgcacgcctgcataaaggagtaacagatagtcgtaccgacaaacttgaaaccgcgttttttcaatgccttagcaagcgcatcggacgcaggtgttgaggtggggatcttatccaggctggccgcctgggtgatctgcggctgaccatcaacgaatgaccagacaaaatcggcgaaagactcgccgttttgctccatcgcaagccaggcgcgggcgttactgataatggcctgaattttaccgcgatgtcgtatgatgcccgtgttctgtagcaggcgttcaacatcctcctcctgcatagctgcgatgcgtatcgggtcaaactgatgaaaacaggcgcggtagttctccctctttttaagcacggtgatccaggataaaccggcctgttgaccttcaagacagatcatttcaaacagctttctgctgtcagtttccggtacgccccactcgttatcatgataggcaatataaagggggtcctggctgacccagtcgcaacgctgcatagacttcctcgttattgtggttaccgcgaaaatttccttcaacccgccttgacgggtccgctaaaaggacaatagttaatacagggctgatgtccgacatccttcattcaatgacaataatatcgccgaattcggctctactctggagtcgcgttgatgattgtaagaaaacgccgtggtcgccggacattgcgttgtctggcgggccttatggcctgctcgttttttatcaataccacgtatgcctggcaacaagaatatatcgctgaagcggctccggggcatacgacggaacgctatacctgggacagcgatcaccaaccgaattacaacgacatactggccgaacgtattcagtctacgcaaaatacggtgggtccggtgcttagcctggcggatgaaaccccgcttgatgcgaccagcggtatcagtatgggctggaatttttcgctttcccgacgcgtaaccactgggccggtcgcggcgctgcattacgacggttcgacgtcatcaatgtataacgaatatggcgatagcgcgacgacattagcgcttaccgatccgttatggcatgccagcgtcagtacgttaggctggcgggtaaactcgcagttcggcgatgtccgtccctgggcgcagatcagctataaccaacagtttggggaaaatatctggaaagcgcagtccgggttgagtcgtatgaccgcaggaaatcaggcgggaaactggctggatgtcaccgtaggcgcggacgtgttacttaacccgcacctggcggcgtatgcggcgttttctcaggcggaaaacagcgctacggatagcgattatttgtataccctgggggtgagcgccaggttttaacgggataaaccgtcgcctggacttattagaagttcagctaataccctatctatatatttacaaaaatatataggtcaatcacattctctatagacactttttgcgcttcctgtggtctacttagccgcgctggtagactttctcacatctgcgttagccgcatatttacctgtttgattaaagaatcgttgtacaggtcgtttttatcccgattcccagggtttgtttgcatgagatacattaaatcgatgacgcagcagaaacttagtttcttgcttgcgctctatatcggtctgtttatgaattgcgccgtgttttaccgccgtttcggcagttatgcgcaagaatttaccatttggaaaggcctttccgcagttgtcgaacttggcgccacggtgctggtcactttcttcttacttcgtcttctttcactgtttggccgacgcgtctggcgcgtgctggccacgctggtggtgctgttttccgctggcgccagttattacatgaccttcctgaacgtggtgattggctacggcattattgcgtctgttatgaccaccgatatcgatctctcgaaagaggtggtggggctgcactttgtattgtggctgattgccgtgagcgtgcttccgctcatctttatctggagtaaccactgtcgctacacgttgttgcgccagctacgtacgccggggcagcgttttcgcagcgccgctgtagtgatactcgcaggcgtaatggtgtgggcgcctatccgcctgctggatgtacagcagaaaaagtttgaacgggcgacaggcatcgacttacccagctatggcggcgtggtggcgaactcctacctgccctcaaactggttatctgcgttagggctgtatgcctgggcgcaggtagatgagtcgtcggacaataattcgttaataaacccggccaggaaatttacctatgttgcgccgaaagatggggatgacacctacgtcgttttcattatcggtgagacgacccgttgggatcacatggggattttcggctacgagcgtaataccacgccgaagctttctttacgctgtatgtttgtacgggaaggtggggcggataataacccgcagcgtacgttaaaagagcagaatgtttttgccgtactcaaacagctcggattcagttccgatctgtacgccatgcagagcgagatgtggttctatagcaataccatggcggataatatctcttaccgcgagcagattggcgccgagccgcgtaaccgcggtaaaacggtggatgacatgctgttgattgatgagatgcagaactcgcttgcccagaatccggagggtaagcatctgattatcctgcataccaagggatcgcattttaactatacgcagcgttatccgcgcagctacgctcaatggaagcccgaatgtattggggtcgatagcggctgcacgaaagcgcagatgatcaactcttacgataactccgtgacctatgttgatcactttattaccagtgtgttcgatcagctacgtgataaaaaagcgattgtgttctacgcggctgaccacggcgagtcgattaacgaacgcgaacatttgcacggtacgccgcgcaatatggcgccgccggagcaattccgtgttccgatgctggtatggatgtcggataaatatcttgccagtccgcaacatgcgcagatgtccgctcacctgaaacagcaggcggagatcaaagtgccgcgtcgtcatgtggaactgtacgatacgataatgggctgcctggggtatacatcgccgaatggcggcattaaccagaacaacaactggtgccatattcccgatgcgcagaaagtcgccgcgaagtaggttgtctgccgactttctcgccgattgaattgtattttgcgactaagggattgacgggcgtgcgcctgagcagtaagatgcgcccgcattcggtgattggcgcagcctggtagcgcacttcgttcgggacgaaggggtcggaggttcgaatcctctatcaccgaccaaattcagaaaccctgctcagcgagcagggttttttgtatctgaagcctgacgaggatgagaacctccgggggcaagaggttcgactcgagcgaagcgagagaacgttgcgtcagcaacggcccgcagtggcaagtcatcctctgtcaccggcaggttgacgctcgcaccaccagttcaggcatgatcccgtcgctgtagctgaccttctcacccgacagaacggcaaacaggagtgtgattgcctgtcgcgccacctcatcaagatgcatattcactgccgtcagcggcggcagcgattcgcgcgcgcggataccgtcatagcgagtaaccacccgtatttgttcaggtatggcgatgtcttgttcctggaaagcccgtaccgcgccgctggcaaaggtatctatcagcaccagcacgccgtcaacgtcgggatgcgcctgtaatagctgctgcgcggcctggtagccggcattttcaccctcgctttcattgagagagtagacgacggggtcctggcgccccgcgcaccagcgctggtaagccgcttcgctctctagaactgatgttcgccgtgtgttaccgacaaataacgcacatttgctggcaccggaggcctccagatgcgttagcagaagctgtgctgttgccgccgagtgcagctcaacccacggcacaggcgtgtcggtccccggcgtgcggccaatggtgacgcagggaatgcccgcttgcgccagcgcctggagctgcgggtcgttctccgccggctcaatcaggatcgccgcgtcaaagctgacggcatccagtggatttacccctggtggcaccagaatcagcgcatgctgtttttccagcgccatcatcgcggacgttaacgccacctccatcataaatcccagtcgtgatgcgccggaggcaatcgccagcggcaccgaagagagcaaagcaatggtattggttttgccggttcgtaactggcgagcgcgaatattcggcgtgtagttgagcgcaacaatggcctcttcaatacgccgtcgcgtctgcggctcgacaaagcgggtgttgtgcaatgcattggataccgtccctggcgagacgcctgcatggcgggcaacatcaatcaactttgcgcgttttttattttgaacagccatctgcttcctgacctgcgaaaatttgcgcacagggtagcatatttaccagacggtaacgtttgctttttttcggtggtgatcgtaaaaaactcttcattaaaacgttttaatggagtattttggcgcaaatctattcctcaggaggcgatgtggcacacttaactcaggattcgactttcacccttggacgccgtccggcgggccttatctacgctgataaggcgaagagctttggcggctatacgctttttgcgccgcaaaccgccgaagggcgggtttacctggtggacgagcagggcgaagtcgcgcatcagtggcagcttccggttcgcgccgggcgtgatgcggtgctgctgccgaacggtaatctgggttataacggcagccaccgcacttcagcgaacctctatccggcgtgggatctctggcacggcggcgacttctacgaagtgacgccggataacgaaatcgtctggcattacgaagatatttaccatcaccatgatgcgcaatggttggcgaacggtaatctgctgtataccgccgcgtcgccgttacctgccgatatcgccgcccgtgttaccggcggcgacccgcgccgcgatgcgccggacggcgtgattcagagcgacgtcgtcaaagaggtcaatcgcgacggtgaagtggtgtgggaatggcgtgcctgggagcatttgaatccggaagatttcccgattcatgatattttcgaccgccgccactggccgatgattaacggcctgtccgtcacccgtgatggcctggtactgatgagcctgcgtaccacttccggcgtcattgccgtggataaagagagcgggaaggttatctggcatgcagggccggaagtggtagcgcagcagcacacgccggttgagatggagaacgggtcgattctggttttcgataacggcaacctgcgtcccggcgtcacctcgccgcattccacggtgctggagttcgatccgcagatcaaagcgattacctggcagtatcgcgatatcttcccgccggcgtttttctcgccgtatatggggagcgcgcagcggctggcgaacggcaacacctttatctgtgaatcggcgtttggccgcctgtttgaagttaccccggaaggcgaaacggtatgggaatatatcattccgttctttaatgaatatccggagcacctcagtaaaggcattattcctggaaaacagaacagcgccttccgtgcgcatcgctatgccgctgatgccattagttggttgaaataatgcagaccgccagcccgcgctggcggttatttttttgatgttttatgggagttaatcatgccgcagcctggccttactacgccggataacgatgcattaccctggcaaaccaccttacttttggcgcttcagcatgtgctggtcgttgccgccacccccattacctccgtctttctgatcgccaaagcgctccactttaccgatacggtgaccgcctcggtacttagcgcgacctttctgatgtgcggtctgggcgctattctgcaaagcctgggtgtgaaaggggtgggcgcgcgtttgccgtttattatggtaccggggggcgcgccgattgcgattttcgttgcgatcgctttacagaccaatatccagaccgcgattggcgccgtaattctgacctcgctgttctactttatcgcgttgctgattttccgccgctgcctgcaccattttcccccctttatcattggcatcatgctgctaatggtgtcgattaaccttattcgcctgtacggcgggttgatcattggccagccagggagcgccgacttcgctcatccaaccagtatcattttatcgctggggactatcctgataacgctgattttcgcgctggcgtttagcggtattttgcgccagctggcggtgatgttcggccttttagcggggacgctgctgggaatggcgctgggcagcaccgattttagcggtgttagtcacgggccgctgtttagtttcccacagcttttgccgttcggctggccgatttttgatctctccgcctcgctgcctttactgatttacgcggtcatctctatggctgaagcaactgggcaaacgattgcgaccgcggaaatagtcaattccacgcaaaatgtgcaacaggcgattccacgtaccattcgtggtgatgcggtaatgtcgctgctggggggatttttggcacctccttaattatcacctccggcgaaaatattggggtgatacgcaccactaacgtgaaatcgcgtttcgtgactgcggctgccggaggattgttaatcctgattgccatattcgcgccgctggtacgtctggcgacctgtctgccaggttcggtggtgtgcggtacggcggtgattgtcttcagcattatcggggttatcggcattgatatgattgcgcgtgagccactgcatacgccgggtaaaacctacgcgctggcgatggggctggccatgggaatgctacctatactggtacccggcctgtatcagaatttcccggcgggcgtacagatggtctttggcaacggcatggcagcggggacgttgacggcgattctggtgaactcgttgtttaactggagcgaaaagcgcacgcaggccagggccaaaagttagtttttgtgatcgcggtaggccgcacgacggcctacttatttacaattttgtaacatattcgatggtgtttttcaatgtccggatcactcttctttgcacacggcttatggataacctcagcattttcgcctgtgcgttttagcgttagtggtattaatcgctcagataatcaacatatcgaaagaaatttttcaattaatggctaattgttaatcactaactgttgcaaaatattaagtgaataactctgcctttctgcctgtagcacaaatttccctgctgaaaatacccttctgaactttttttaatctttgtttgttaattctcaccgttgttgtaaaagctggttacctgtattgacgttttgacattctattgacagattgtagggaatgaggggcattttatggagaatccgcactgcaactcagtcgattatgcgaacggaatccccacctctcactactgacctgaccaggtaaaaaacaaaaaaggccgagcggtaaaagtctttgcaaagggcaaaacaacatacatcacaattggagcagaagaatgagtatttccttgaagaagtcagggatgctgaagcttggtttgagcctggtggccatgaccgttgcagcaagcgtgcaggccaaaaccctggtttattgttcagaaggctcgccggaaggctttaacccacagctctttacgtctggcaccacctatgatgccagctccgtacctatctataaccgtctggttgaattcaaaaccggcaccacggaagtgatcccgggtcttgctgagaagtgggatatcagcgaagacggtaaaacctatacgttccacctacgtaaaggggtgaaatggcaatccagcaaggatttcaaacccacgcgcgagctgaacgccgatgatgtcgtgttctcttttgaccggcagaaaaacgagcagaacccgtaccataaagtgtctggcggcagctatgaatactttgaaggcatggggctgccggatctgattagcgaagtgaagaaggtagacgatcacacggtgcagtttgtgctgacgcgtccggaagcgccgttccttgccgatttagccatggacttcgcctctattctttccaaagaatatgctgacaacatgctgaaagccggtacgccggaaaaagtggatctgaatccggtcggcactggcccattccaactggtgcaatatcagaaagattcccgcattctctacaaagcctttgacggctactggggcacgaagccgaaaattgaccgcctggttttctccattacgcctgacgcctctgtgcgttacgccaaactgcagaagaacgaatgtcaggtgatgccgtatccgaacccggcggatattgcgcgcatgaaagaagataaaaacatcaacctgatggagcaggccggtctgaacgtgggttatctctcctataacgtgcagaaaaaaccgctggatgacgtcaaagttcgccaggcgttgacctatgccgtgaataaagaggccatcatcaaagccgtttatcagggcgcaggcgttgcggcgaaaaacctgatcccgccgacgatgtggggctacaacgacgatattaaagactacggctacgatccggaaaaagcgaaggcgctgctgaaagaagccggtctggaaaaaggcttcaccatcgatctatgggcgatgccggtacagcgtccctataacccgaatgcgcgtcgtatggcggaaatgatccaggcggactgggcgaagattggcgttcaggccaaaattgtcacctatgaatggggcgaatacctcaagcgcgctaaagatggcgagcaccagacggtgatgatgggctggaccggcgataatggcgatccggataacttcttcgccacgctgttcagctgcgatgccgcccagcaaggctccaactattcaaaatggtgctacaagccgtttgaagacctgattcagcctgcgcgtgcgaccgatgaccacaacaagcgtattgaactctataaacaggcccaggttgtgatgcatgaccaggcgccagcgctgatcatcgctcactccacggtttatgagccagtacgtaaagaagttaaaggctatgtggttgacccattaggcaaacatcacttcgaaaacgtctctgtcgaataattaaaagagcgctgcgccccggtgttgtgtaggccggataagcgcagcgccatccggcgtaatgctttatccgcgatgcagtttgcgtgggataagatttgtgagcaatacagactcacggttccaggccgtgcgtcatgagagagaattcgggttatgttgcagttcattctccgacgtttgggactcgttatcccgacgtttatcggtattacccttctcacctttgcctttgtccacatgatccccggcgatccggtgatgatcatggcgggtgagcgaggtatttcccctgagcgtcatgctcaactgctggctgaactcggtcttgataaaccgatgtggcagcagtacctccattatatctggggggtgatgcatggcgatttaggcatctcgctgaaaagccgaatccccgtgtgggacgagttcgtacctcgctttaaagcgacgctggaacttggcgtctgcgccatgatttttgccgtcgccgtggggattccggtgggcgtgctggccgcagtgaagcgcggttctatcttcgatcacactgccgttggcctggcgctgaccggttactctatgcctatcttctggtggggcatgatgctgatcatgctggtctccgtccactggaacctgacgccggtttccgggcgcgtgagcgatatggtgttccttgatgataccaatccgttgacgggctttatgctgatcgacaccgctatctggggcgaagagggtaactttattgatgcgctggcgcatatgatcctgcctgcgatggtgctcggcacaatcccgctggccgtcattgtgcgtatgacccgttcgtcgatgctggaagtgctgggggaggattacatccgtaccgcacgcgccaaagggttgaccaggatgcgcgtcattatcgtccatgctctgcgtaacgccatgctgccagtcgtcaccgtgatcggcctgcaggtcgggacgctgttggctggcgcgattctgacagaaactatcttctcgtggcccggtctggggcgctggctgatcgatgcgctgcaacgccgcgattatccggtagtgcagggcggcgtgttactggtagcgacgatgattattctcgtcaacctgctggtagacctgctgtacggcgtggtgaacccgcgtattcggcataagaagtaaggggccatcatgtcacaggttactgaaaataatgttaatgccgcaccggcgcccatgacgccattgcgggagttctggcactatttcaaacgcaataaaggcgcggtcgtcgggctggcgtatgttctcatcgtgatcctgattgcggtgtttgccaactttattgcgccgtacaacccggcagagcagttccgcgatgcgctgctggcgccgccggtctggcaggaaggcggcagttgggcgcatattctgggaacggatgatgttggtcgcgatgccctctcgcgcctgatgtatggcgcgcgtttgtcgctgctggtcggctgtctggtggtcgtcctgtcgctggtcatggggattattctcggcctagtcgcgggctacttcggcggtctggtcgataacatcatcatgcgcgtggtcgatattatgctggccctgccgagcctgctgctggcgctggtgctggtggcgatcttcggcccctccatcggcaacgctgcgctggcgttgacgtttgtggcgctgccgcactatgtccgcttaacccgcgcggcggttctggtagaggtgaaccgcgattatgtgactgcctcccgcgtggcgggcgcaggcgcgatgcgtcagatgttcgtcaatattttcccgaactgccttgcgccgctgatcgttcaggcatcgctcggtttctctaacgccattctcgatatggccgccctcggctttcttggcatgggcgcgcagccgcctacgccggaatggggcaccatgctctctgatgtattgcagttcgcgcaaagcgcctggtgggtcgtgaccttcccggggctggcgattctgctgacggtactggcatttaacctgatgggtgacggtctgcgtgacgcgctcgatcccaaactgaagcagtaagaggttcgagatggcgttattaaatgtagatcaattatcggtgcacttcggcgacgaagggacaccgttcaaagccgtcgaccgcattagctacagcgtgaagcagggtgaggtggtcggtattgtcggcgagtctggttccggcaaatccgtcagctcgctggcgattatggggcttatcgattacccaggccgcgtgatggcggaaaacctgctctttaacggacaggatctgaagcgcatttccgagaaggaacgtcgcaacctggtgggcgctgaagtggcgatgattttccaggacccgatgaccagcctcaatccttgctataccgttggctttcagattatggaagccatcaaggtacatcagggcgggaacaagaaaacccgtcgtcagcgagcgattgacctgttgaaccaggtgggtattcccgatccggcttctcgtctggatgtctatccgcaccagctttctggcggcatgagtcagcgcgtgatgattgcgatggccatagcctgtcgaccaaagctgttaattgctgatgaaccgaccacggcgctggatgtgaccattcaggcgcaaatcattgagctgctgctggagttgcagcaaaaagagaacatggcgctggtgctgattacccatgacttggcgctggtggcggaagcggcgcacaaaattatcgtcatgtacgccgggcaggtcgtcgaaaccggcgctgcgcaggatattttccgcgcgccgcgtcatccgtatacccaggcattgctacgtgcgttaccagagtttgcgcaagataaagcgcgtctggcgtcgctgccgggcgtggtgccggggaaatatgaccgaccgacgggttgtctgcttaaccctcgctgcccccacgccacggacagatgtcgtgcggaagaacctgctctcaaccaactggacgatggacgtcagtcaaaatgtcattacccactcgatgatgccgggaggcccacactatgagtacgcatgaggccaccttgcaacagccgctgttgcgggctatcgacctgaaaaaacactatccggtgaagaaggggatcttttctccggaacggctggtaaaagcgctggacggcgtgtcgtttaatctcgaacgcggtaaaacgctggcggtagtgggggagtccggttgtggaaaatccacactgggtcgcctgctgacgatggttgaaacgccaaccggcggcgagctttattaccaggggcaggatctgctcaaacacgatccgcacgcgcagaaactgcggcggcagaaaattcagattgtgtttcagaacccctacggttccctgaacccacgcaagaaagtggggcaaattctggaagaaccgttgctgattaacacctcgctcagcaaagagcagcgccgtgaaaaagcgctggcgatgatggcgaaggtggggctgaaaaccgagcactacgaccgctatccgcatatgttctccggcggccagcgtcagcgtatcgctatcgcccgcggtctgatgcttgatccggacgtagtgattgccgacgaaccggtctccgcgctcgacgtgtcggtgcgcgctcaggtgctgaacctgatgatggatttgcaacaggatatggggctgtcttatgtctttatctcgcacgacctgtcggtggtggagcacattgccgatgaagtaatggtcatgtacttaggccgctgcgtggagaaagggaccaaagagcagatttttaacaatccacgtcatccctatacccaagcgttgctctccgccacgccgcggctgaatccggacgatcgccgtgagcggattaagctgaccggcgagttgccgagtccgctgaacccgccgccgggctgcgccttcaacgcccgctgccgccgtcgcttcggaccctgtacgcagttacagccgcagcttaaagagtacgacggccagttggtggcctgctttgccgtcgatcaggatgaaaacccgcagaagccgctgagttaattgcgttttatgccggatggcggctgcgccttatcaagcctacaccttacttgtaggcctggtaagcgtagcgccaccgggcatggctctccggtacgacttagagcctatcccattagggctattttacttgccattttggacttgggcagtgctcgccaaaacgcgttagcgttttgaacgccgctagcggcggcccgaagggcgagcgtagcgagtcaaacctcacatactacgtgtacgctccggtttttgcgcgctgtccgtgtccaaactggctgtgccaataacgcctggtgggataggctcttattcaatcaattttaataacggcgacaggcacaacaatattccatataacagaataagccaggttttcaggccgcgtaatttttccagttgcgctactttataaatcaggaaaaagggaataatacacgcgacaatgccataaagcggactgcctaactggaaaaagaccaatactgagacgcgaaacgaaacccaaataaccagagtaaccacgataaagacacagattccagatgtcagtaacagtgggttgatgtttttgacatccataatgcgactcaacacattcagtacaatacctttaagcgcttcgtgaaaacctaaataaataccaaagaacgcggtaagtacggcaaaaatattgaggatggtagaggtaatgtggatgatctggccagggattacctgagctgccagcgcaagagcggaaatattctgctcgaacgctgataccgcctcttcatgactaatcgaaaaggtaaacgaaaacgagaaaaagagaataatggcaatcagcgtaatatagctaatgcgatgcgtgcgaatcgccatccgggtggccagcacacggtcaggttcgcgcttacgataggcgatgttcattgggtttagcacctgaatgaagaccgcagaaaagaagcaaaatgggatagtgagcagtacgtcgcgaaagaaaaccgatgcggcgggaaaggcggaaatattatcaagattccagtgtgggatcatcgccaaaccgaatatcagaatgatcccgacttttaccactaccatcgggccggaaattttaaataatagcttttccccgccggaggcaatcgccaccagcacggcgaaaatcgcgactttatagataatagactgcgaaagatcggcctcagtaaggccgaaggttttgatataggaggcgctatcaaacaccaccgacagggagtaaataaacaccccgtggataatcataagaaaatagattacaccgagaaaaacgccccagtttttgccaagatagtgactgataatatccgtataatcgtcacaggtttcgctttcagataacgtttttagataaatatcctgcacaatataggtagcgggataggcgatgataaaagcggtaataaatacccagatccccttgagaccgatttgcactggcattaagacggtaccggcgccgattgccataccgatacacaagagcacccagccaaaatcatattttgtaaacggtaatctcgttgaaagcggtgtggtcgtagcgttactgttatttaatggtaatgtgtcgtcctgcatagagccccctgcccaaaatatacgcagctctctcataaagaatgctgcctataaccaggctatagtgccttgatacccgatgcggcaaaccggtgacagcggttcgccgagcaatcgtcagaatgctgcttttctgctggcgcgttcaaggtcatgaataatatcgtcgggatcttcaggtcccgctgaaagacggataagttcgtcggtaatacctgcttttagccattcctctggcgcaacaggcgaatatgtcatagacgcaggatgctgaacgagggtttcggtatcaccgggactggccgcgaggaggcataatttacagaattgagcggctgactgccagcctcagaaatgctgaatgtattctggcaaataaaagtagtcgtctgcgaagcgtcacgcagattgcacgttagcgccgtgccgggacggggattttgccgtaatatcagcagcaagccgggtttacccggtgaggcgcaatgttgcgggggcttgagccccggcggcataggttgctggatagagaaaacccccgcacgttgactggtataaacctggcaacctgacgggggctaacttgaacccaaacactttaaagatagccgcgaacggttgccattgcaacaaggcggctatatgacgcttacgcagttgggcgtggccttctggcacgatctggcggcgccgatcattgctggcattatcgccagtgtgatcgtcaactggctacgtgacaggaagtaacgcgttttgagcgtctgtccgccgtaatggcaacatgcgcccgagccaggccgcaggggaaaccttgcggcctttttcggtttactgcgggtaaggcacccagtcgccgccattcagacgaacgtagggcttaccctggtactgaatcaccaccgcattagcgttttctgaaaccggcgcggtttgcggcagattgctggtcagcttgttccagttcacactgtcttcggtaaagagcttaccgtccacggcgcgtacgaccagttcggaaatcgccaggtagctgctcggctgattaatatcaatcggcgcgccctcatgcggggctttcatgccaaaaaatttcacgcccgccgggacgttggtgatggaggggctgggaatatcgcgcaggcctgagatctgcattctgtcgcccttcagcgcgccgccgtgctccggtacgacgactaccatcaccttacgcccggatttctccagttcggtaaagaaggcgtccagttcatcgaacagtttctgcgcgcggattttataatccgccgttttgctgacgccagggaagtggttgccatcgtgcagcggcagcaggttaaagaaagtcgcggagcgggaattggcttcacgttcttcccctgttaaccagcggttcaggaccgccagatcgtcatataccggcgagccgtcgaatgacagcagggcggttggcaggccggactggttcatcagttcgctctgcataccgccgttttcgcgaacttctttcaggaagccgccaaattcaccgttatgatccatcatcagatgctgagtaaagcccagtttcgccagattatcaaacagataacattcgttattggctggttgataaagtcgggtatgcgaaggttgaccacagctggcgcgcagcagacgaatggccgccgggccgctgtaagacgtaccggaattaaagtgtttaaacaaaatgtcaaagtgcgaccatagcggatgtgacatcaggcctgccgcttcgacatccgaccaggagagcgaacaaatattgatgaccaataggtcgaacggctgcgcatcaggcggaagctgcgccgggaacgtcgttttccgcttttcttccgcggcatagaaggtgttcaaccaggcgttcagattcgcggtcgttggcggcgcggtttgcgcaggcatatcgccgatgaccggcttatcgcccgctgtcgcgacggtagcggccgcgttaccgccagtcgtcgtcaccgtatcggttggctggcctgccggccacagcgtaaaaaccgggccggttaatgtcaggacattcagccataccatgatggcgaccacaaacaccgtaacccgaatccactgtgataaaaatagccaggcaaccagcagtacgaagatggcgccgatcatttgccagttaataaaacgggcgatcagatcgagcagataaccggagctgaattccgccacctgcgtcccctggctcataatgctttgcgggccgggcagccaggtatcatgccagaacagcgcgaagccgacgggaatggcaatccagtggcgcaaccggtgaaggcgatattttggtattggcatgagcagaaacgccatgaataccagattcagtaaaggatgaaaattcagatagcctgcccacagcaggccaaacttgaccagaaaatagaagttccagccggaaagaccgcgccagtattgccagagcggagaaggcattgaaggagtttgagtatgctgagtcattttttgtctgccttgactttcgtagcgcggcgcagagttccggctggttttacataacgaggtttggcaaatagcagccgggtcgtatcactgatacggcgtagcgaatgacgcgccagataccccagcggaaagaaaatcagcgcgcaaaaaagaataatttgcacgatatcgctgatggtcatcatgatgcacgctccgcggtgtcgtcgagcaatcgcaggggttcaggaatacgacgccagatgcggccatcgtgttcggcatttattaccgggtcggcgcgttttgccagcggtagcggcgttccccacagttccggcgacaataagcgcatctgcaccagctcggcgctgatttgtttatcttcgaaccagaccatacgattagagaaaatatcgcctgtcggcaaagggaaaatatggtttaacgcggtatccagatcgttgacccggcagaatgataaaaacagcaccagacggttgccgccgatggtcataatatcgccggttcggcttggtcgacataatgttaacgcctgctcaacccgaatgcccggcaccgggcgcagcgcgaccagaacgcctttcccgtcggcggggagcagggtgttgctcatcatcgtatggatggcatcgcaaaaggtatcccacggctgaaaaccgcgcagtttcaacggttgcgtcatcgacagtagcgtggtgatgtcttccggtacgtaacggctgaactgctgcccctgcacgctttcaataagcgtcagacagcgtgaaagcggggcgttccagggaatgatcatattcgcgccgcagcccagcagcaggcgctcatcggtggcgcgcaaactggcgatattttcgcgcacgacaattttcagcgcgcttccccgctggcgtcgcaaagtatgaatgcgacgagcaagcggttcgatttggttgttctgtgtaagcgaaaaaataattgtcgcggcctgcgccgtgcgcgcgtcgttgaatagcgcttcgttattgtcgaaaagcgtccagtgttccgagagcggcggcgcgccttcaaggacggcgacgtggctaagaatgcgtttttcgtcgctacgcggctgaattgccgtctcctcctgatgggatagcgtccagcgttcgtcctgctgacatagcaataactgctgtcgggcgctgacgcctttttcgttacaccagaaggcaatatcgaacaaatgttggtcgccctgaaaacgtaaactggcgaggccgaaaagtgagcgatactcgcccatcaacaacgaggactgtttatcactattattacaaggggtaataaccaacaatgaacagtgatgaaaacgagtccatttattcattttttccagccatttatgcaggctttctgacgttatattccgccacgtgttatttgcacaaataagaatgaaaaagtaatgcgtcgggttaacagaacaaagcaaatcgtggggcaaagagtatagccctttttctgaatccggcatggtaaataagcggattttctccggaccgtgagattcatctaatttgattactttgccaggatcgccttccatgccgatgacggcgacatttgcattctccgtttgtgacgcaatcgtttgattcaccaggctgatggcatcttgctggcgatcggcgttaacccaccagacgccgccggttggcatatggcgcagttcatcccataatgatgagatgccgagagaaaatacggggtccacagtgtccctcatgtcactattttaactgtttatcagtttactagcgaaagcacagaaataaacctaacattgaaattaaaacgcatcagatttagcatgtgaatcaatttgtccggcaggatgccctgtaactctgcgctttgcatttttacacattataaatgatgtcacggaaagatgaaaaatgcgcgttctcccgtattgacgacggggcgtaatgctgccagtgagaaatatttaaaaaggagcaaccagaatgtataacaatgaacctggcgctcagtccgatccaacgttgggctacacttttcaaaatgattttctggcattaagccaggcgttttcactacccgaaatagattataccgatatttcccaacgcgaacagttggcggcggcgattaaaagatggccgctcctggctgaatttgcgcaaccacattcattaaggaagccatgaatggcgattctgggactgcagggcgtgcgcggcggggtgggaaccacatctctcaccgcagcactcgcctgggcgttacaaatcttaggggaaaatgtcctggtgattgacgccagccccgataacctgctgcgcatgtcgtttaacgtcgacttcgtccatcagggcggttgggcgcgatcgttgctggacggccaggactggcgcgatgccgggttacgttatacctcgcagcttgatctactgccgtttggacagctcacctcgcaagaatgggaaaatccgcaggcctggcaggagacgctgggagagatcggatcggctatccaggcgctgaaagcgagcgggcgttatagctggattttactggacttgccctacggcgagtcaccgctgacacgacagctggtgagcctctgcgaccatacgctggcgatagcccaggttgacgctaactgccatattcgccttcatcagcaggcgttgcctgccggagcgcatattctgatcaatgacttacgcattggcagtcagttacaggacgatctgtaccaggtctggctgcaaagccagcgccggttgctgcctattgtgatccatcgcgatgaagcgatggcggagtgcatggcgtcgaaacagccgttaggcgagtatcgcagcgattcgttagccgccgaagaggtgttaacgctggcgaactggtgcctgctgcacgatgcgggcgacaaaacgtctgccgggagcctgcgatgagcgccctttcccggtggctgcttatcccgccggttagcgcgcgcttgagcgagcgctatcagggttaccgccgccacggcgcgtcgccgtttagcgcagcgctcggctgcctgtggacgattctggcgtggatagtgtttccgcttgagcatccgcgctggcagcgtattcgcgacgggcataaagcgctttatccgcatattaacgccgcccgcccgcgcccgctggacccggcccgttacctcattcagaccctctggctggtgatgatctcgtcgactaaagaacgtcatgaaccgcgctggcggtcatttgcgcgcctgaaggacgttcgtggacgttaccatcaatggatggataccttaccggaacgggtgcgccaaaagacaacgcacctggaaaaggaaaaagagctgggacatcttagcaacggcgcccggcgttttattctgggcgttatcgtgaccttttcactgatactggcgctgatctgtattacgcagccatttaacccgctatcgcaatttatctttctgctgttgctgtggggcgttgcgctgttggtacgacgtatgccgggacgcttttccgcgctgatgctcatcgtgctgtcgctaacggtctcctgtcgttatatctggtggcgctatacctcgacgctaaattgggacgacccggtcagtctggtgtgcggactgattctgctgtttgcggaaacctacgcctggattgtgctggtgctggggtacttccaggtggtgtggccgttaaatcgtcaaccggtgccgttgccgaaagagatgtcgcagtggccgacggtggatatttttgtaccgacctataacgaagaccttaatgtggtcaaaaataccatttacgcttcgcttggcattgactggccgaaggacaagctgaatatctggatccttgatgacggcgggcgcgaatcatttcgtcagtttgcccggcatgttggcgtgcattacattgcccgcgctacgcatgaacacgccaaagccggcaacatcaacaatgcgttaaaacacgcgaaaggcgagtttgtggcgatcttcgattgcgaccatgtaccgacgcgctcgtttctgcaaatgacaatgggctggttcctgaaagagaaacagctggcgatgatgcagacgccgcatcatttcttctccccggacccgtttgagcgcaacctgggacgttttcgtaaaacgcctaacgaaggcacgctgttttacggactggtgcaggacggtaacgatatgtgggatgccactttcttttgcggatcgtgcgcggtgattcgccgtaagccgctggatgagattggcggtatcgccgttgagacggtgacggaagatgcgcatacttcgctccggctgcaccggcgaggttatacctcagcgtatatgcgcattccgcagtcggcggggctggcgacggaaagcctgtcggcgcatatcgggcagcgtattcgttgggcgcggggcatggtgcaaattttccgcctcgataaccctctgtttggtaaaggcttaaaactggcgcagcggctgtgctacctcaacgcgatgttccatttcttgtccggcattccgcgcctgatctttctgaccgcgccgctggcttttctgctgctgcacgcctatatcatttatgcgcctgcgttgatgattgcgctatttgtgataccgcacatggtccacgccagcctgactaactcgaagattcagggcaagtatcgtcactctttctggagtgaaatctatgaaacggtactggcatggtatatcgcaccaccgactctggtcgcgttgatcaatccgcacaaagggaaatttaacgtcacggcgaaaggcggactggtggaagagaagtacgtcgactgggtaatctcgcgtccgtatatcttccttgtcttgcttaacctgctcggcgtggcggcgggcgtatggcgatactattatgggccggaaaatgaaacgctgaccgtcatcgttagcctggtgtgggtcttctataacctggtcattctcggcggcgcggttgcggtttcggtagagagtaaacaggtcaggcgcgcgcatcgggtcgagattgccatgccgggggccatcgcccgcgaagatggacatttgttctcctgtaccgtacatgacttctccgacggcgggttaggcatcaagatcaacggtcaggcgcaggtgctggaagggcagaaagtgaatctgttgcttaaacgcgggcagcaggaatatgtctttccaacgcaggtagtgcgcgtaacgggcaatgaggtcgggctgcaactgatgccgctcaccaccaaacaacatattgattttgtgcagtgtaccttcgctcgcgccgatacgtgggcgctttggcaagatagcttcccggaagataaaccgctggaaagcttgctggatattctgaagctgggcttccgcggatatcgccacctcgcggagttcgcgccgccttcagtaaaagtaattttccgatcgttgacggcgttaattgcctggattgtatcgtttattccgcgtcgcccggagcggcaagcggcgatacagccgtcggatcgggttatggctcaggctcaacaatgatgataatgcgatgaaaagaaaattgtcctggatgtgtgcggcggtaataggattaagcgcgtttcctgctttcatgacggcggcggcgcctgcgatgccgccattgatcaatgctgaacccaccgagcctgcgcagtcgcccgtaactgaggcgcccgtcgtggcgcagaccgcgccttcgcgcgaggtcaagctgacctttgcgcaaatcgcgccgccgccgggcagtatggcgctgcgtggcgttaaccctaacggcggcattgaatttggtatgcgcagcgatgaagtggcgtcgaaagcggtgttgaatctggaatatacgccctcgccgtcgctcctgccggttcagtcgcagctcaaggtttatctcaatgatgaactgatgggcgtactgccggtgacaaaagagcagttggggaaaaagacgctggcgcaggtacctatcaatccgctatttatcaccgactttaaccgggtgcggctggagtttgtcggccactatcgcgacgtgtgtgaaaacccggccagcagtactctgtggttagacatcgggcgaaatagcgccctggatctgacctataacatgctggcggtgaataacgatctgtcccacttcccggtgccgtttttcgatccgcgggataaccgtccggtgacgttgccgatagtgtttgctgacatgccggatctggcgcagcagcaggcggcttctattgtcgcgtcctggtttggctcgcgggcgggctggcgcggtcagcgcttcccggtgttgtataatcacctgccggatcgcaatgcgatcgtgttcgccaccaacgatcgacgccccgatttcctgcgcgatcatcctgcggttaacgcgccggttatcgagatgatgaaccatccggataatccgtatgtgaagttgctggtcgtgtttggtcgagatgataaagacctgttgcaggcggcaaaaggtatcgcgcaagggaatattctcttccgtggttccagcgtggtggtcaacgatgtaaaaccgctgctggcgcgcaaaccgtatgatgcgccgaactgggtgcgtaccgatcgcccggtcacttttggcgagctgaaaacctatgaagagcagctccagtcgagtgggctggagccggcgcccatcaacgtttctttgaatctgccgccggacctctatttgctgcgtagcaacggtattgatatggatctcaactatcgttatacctcgccgccgaccaaagacagttcgcggctggatatcagtctgaataaccagttcttgcaagcctttagccttaacagcacgcaggaaactaatcgactcctgttgcgcctgccggtacttcagggactgctggatggtaaaacggatgtgtctattccggcgctcaaactgggggcgatgaaccaactacgttttgatttccgctacatgaatccgatgccgggcgggtcggtggacaactgtattactttccagccagtaccgaatcatgtggtgataggggatgactccactatcgatttttcgaaatattaccactttatcgcgatgccggatttacgcgcgttcgccaatgcgggtttcccgttcagccggatggccgacctgtctgacacgctggcggtgatgccgaagaccccaaccgaagcgcaaatggaaacgctgctgaatacggtcggcgccattggcgggcagaccggtttcccggcaattaatctgacaatcaccgatgatagcgctcagatagccgacaaagacgccgatctgctgattattggcgctattccgggcaagctaaaagacgataagcgtatcgatctgttggtgcaggcgacacaaagctgggtaaaaaccccgatgcggcagaccgctttcccgtcgattatgccggatgaggccgatcgcgcggcggatgcgcagtccaccgtcaccgccagcggcccgatggcggcggtggtgggcttccagtcgccgtttaatgatcagcgcagcgtgattgctctgctggctgacagcccgcgcggttaccagctactgaacgacgccgtgaacgacagcggtaaacgcgccgcgatgtttggttccgtggcggtgatccgcgagtccggcgttcacagtctgcgcgttggcgatatctattacgtcggacatctgccgtggtttgagcggctgtggtatgcgctggcgaatcacccggtgctgctggcggtactggcggccctcagtgtggtattactggcgtgggtattgtggcgtctgctacgtattctcagtcgccgtcgtctcgaccctgaccatgagtaacgcatgatgactatgctgcgcggatggataacgatgatcgtcatgctgacggcaataaatgcgcaggcagcgtgtagctggcctgcgtgggaacagttcaagaaagattacattagccagcagggacgcgttatcgatccgggcgatgcgcgaaaaattaccacctccgaagggcagagctacgccatgttctttgccctggcggcgaacgatcgaccggcgttcgcgcaactgtttaactggacgcaaaacaatctggcgcagggatcgctgcgtgaacatctgcccgcctggctgtggggacaaaaagatcccgacacctggtcggtgctggacagcaactccgcgtccgacggcgatatctggatggcatggtcgctgctggaggccggtcgcctgtggaaagagacgcgttataccgaggtgggcacggcgttgctaaaacgcatcgcccgcgaagaggtcgtgaatgtgccggggctgggctcaatgctgctacctggcaaaatcggctttgccgaggcgaatagctggcgttttaacccaagctatctgccgccgcagttggcgcaatactttagccgttttggcgcgccgtggtcgacgctacgggaaaccaatttgcggcttttgttggaaacctcgccgaaaggtttctcgccggactgggtgcgttatgaaagcaagcaaggctggcagttgaaagcggaaaagacgctgatcagtagctacgatgcgattcgcgtctatttatggacgggaatgatgcatgatggcgatccgcaaaaagcgcgtttactggcgcgatttaaaccgatggcgacgttaacgatgaaaaacggcgttccaccggagaaagtggatgtcgtcagcgggaatgcgcaagggacggggccggtcgggttttccgccgctttactgcctttcctgcaaaatcgcggcgcccaggccgtgcagcgacagcgggtcgcagaccattttcctggcagcgatgcctattacaactatgtgctgactctctttggacaaggctgggatcagcaccgttttcgcttcaccgtcaaaggtgaattattacctgactggggccaggaatgcgtaagttcacgttaagtctcatgcacgcttttttgctggctggcggtcgaaatgccttacctggcaaaaggggcgtttctcgggcattgttggggttatcgcttggtatggcgctaacaccgcttgccggcgcagcgacctccgcgcagcaacagttgctggagcaggtgcggctgggcgaggccacgcaccgtgaggacttagtccgtcagtcgctctatcgcctggagctgatcgaccccaatgatccacaggttatcgccgcccgtttccgctatctgttgcgccagggggatagcgacggggcgcagaagctacttgatcggctggcgcaactggcgccggagtcgacggcgtatcaatcttcccgcaccgcgatgctgctctccacgccgcaaggacgccagtctttgcaggaggcgcgtttactggcgacgaccggtcatactgaacaagcgatcgccagctacgacaagctgtttaaaggttatccgccggagggcgaactggcggtcgaatactggacgaccgtggcgaaattgcccgcccgccgtcacgaagcgattaaccagctacagaaaatcaatgccgtcagtccgggtaataacgctctgcaaaatgcgctggcgcaactgttgttcgccagcgggcggcgcgatgagggattcgcggtgctaaaacagatggcgaaatccagtacgggacgcagcgcggcctccgccatctggtaccagcagataaaagatctcccggttagcgacgccagcgtaaaagcgttgcaagactatctgacgcagtttagcgaaggcgatagcgtgtctgccgcccgcgcccagcttagcgagcagcaaaaacagttagccgatccggcgtttcgcgcgcgctcgcagggcatcgcggcggttaatgccggagaaggcggcaacgctattgcgcaatcgcagcaggcggtgagcgcccggcaggacgacagcgaggcggtcggcgcgctggggcaggcatactcacagcgtggcgatcgcgcccgcgccgtcgcgcagtttgaaaaggcgctggcgatggcgccgcacagcagcagccgcgataagtgggagagcctgctgaaggtcaatcgctactggctgttaattcagcagggcgacgcggccttaaaagcgaataatctggctcaggcggagcgtttctatcagcaggcgcgagcagtggataacaccgacagctacgcggtgctggggctgggggatgtggcgatggcgcgcaaagataatgccgccgccgaacgttattatcagcagacgctgcgtatggacagcggtaataccaatgctgtacgcgggctggcgaatctttatcgttagcagtcgccgcaaaaagccgccgcgtttatcgcttctctttccgccagccagcggcgcagtatcgacgatatcgaacgcagtctggaaaatgaccgtctggcgcagcaggcggaaacgctggaaagcgagggcaaatgggcgcaggccgcagaactgcaccgccgccggctggcattagatccggggagcgtgtgggtaacgtatcgactgtcacgcgatctgtggcaggccggacagcacgcccaggccgatgcgcaaatgcgctctctggcgcagcagaagccaaacgatccggaacaggtctatgcttatgggctttatctttccggcagcgatcggggccgggcggcgctggcgcatctcaataccctgccgaccagccagtggaacagcaatattcaggaactggcgggccgattgtaaagtaaccaggtgctggaaagcgctaaccgcttgcgcgatagcggcaaagaacgcgaagcggaagcgttgttacgtcagcagccgccctctacgcgcattgcgttaacgttggcggactgggcgcagcagcgtggcgataatgcggcggcccgcgccgcttatgacgccgttctggcgcgggaaccgggtaatgtcgatgccatgctggggcgggtggaaatcgacatcgcacagggcgataacgctgcggcgcgcgctcaactggcggcgctgcctgcgtcgcaaatcacctctattaacatgcagcgccgcgtcgcgctggcgcagctccagcttggcgatatcacggcggcggcgcggatctttaaccgcattacgccgcaggcaaaagcacagccgccatcaatggaaagcgcgatggtattgcgtgacgccgccgcttttcaggcgcaaacgggcgagccgcagcgggcgctggagacctacaaagaggcaatggtcgccgcggcgattacgccggttcgcccccaggataacgatacctttacccgcctgacgcgcaatgatgaaaaagatgactggctaaaacgcggcgtgcgtagcgatgcggcggagttgtaccgtcagcaggatctcaatgtcacgttggcgcacgattattgggggtcgagcgggactggcggctactccgatctgaaggcgcataccacgatgcttcaggtggatgcgccctggtcggacggacgggcgttctttcgtactgatatggtgaatatggatgttggtcgcttctctacggatgcagatgggaaatacgataataactggggtacctgtacgctggagaaatgcagcggacatcgtagccaggccgatacgggcgcgagcgtggcggtcggctggcagaatgagacctggcgctgggatatcggcacgacgccgatgggctttaatgtcgttgatgtggtcggcggcgtcagctatagcgacgatatcgggccgttgggttataccctgaacgcgcatcgtcgcccgatctccagctcgctgctggcgtttggcgggcaaaaggacgccagcagcaataccggcaccaaatggggcggcgtgcgggccaacggcggcggcgtcagtctcagctatgataaaggcgaagcaaacggtgtctgggcgtcgctcagcggcgaccagttgagcggtaaaaatgtggaagataactggcgcgtgcgctggatgaccggttattactataaggtgattaacgagaataaccgccgcgttaccgtcgggctgaataacatgatctggcattacgacaaagatctgagcggttattcactgggtcagggcggttattatagcccgcaggaatacctgtcgtttgcggtgccggtgatgtggcggcagcgtacggaaaactggtcgtgggagttaggcggctcggtatcctggtcgcactcccggcaaccgtaccatgccgcgttatccgctgatgaatttgattccggcggattatcaggaggatgcgcgtgaccagaccaacggcggcggcagcagtcagggatttggctataccgcgcgggcgctcattgaacgccgggtcactgccaactggtttgtgggtacggctgtcgatatttagcaggcgaaagattatacccccagtcatctgctgctgtatgtccgttattccgcggcaggctggcagggggatatggatttaccgccgcagcctctggtgccttacgctgactggtaatcattgcgtcaggcctacgtattgacaggcgtcgtaggcctgagaagcgcagcgccatcagacgctatcattaaccgttattcagaaaagtccttttcagatacagcctctcttaatgccgctgcaatcgggtatactcaggcggcagtccgggatatccagggagagtcaatttgcgcgtcagccgctcgttaacaattaaacagatggcaatggttgcggccgttgtcatggtgtttgtttttgtcttttgcaccgttttgttgttccatctggtacagcagaaccgctacaacacggctacgcaactggaaagcatcgcgcgctctgttcgggaacctctttcttccgcgattttaaaagcggatctccccggcgcggaaaccattctggaaagtattaaacctgcgggcgtggtgagtcgcgccgatgtggtattgccgaatcagttccaggcgttgcgtaagcgcttcattcctgaacgccccgtcccggttatggtgacgcgtctcttcgaactgccggtacaaatttctttgccggtttattcgctggagcgtcccgccaatccgcaaccgctggcctaccttgtattgcaggcggattcgtaccgtatgtacaagttcgtcatgagcgcgctctctacgttagtgaccatttacttacttttatcgctgatcctgacggtggccatcgcctggtgcgtaaaccgcctgattgtgcatccgctgcgcaaaatcgcccgcgagctgaacgacattccgcagcaggagctgatcggacatcagctggcgttgccgcgtctgcatcaggatgatgaaattgggatgctggtgcgcagctataacctcaaccagcagcttatgcagcgtcaacgcgaggagcaaacggacaacgcgatgcgttttccggtttccgagttgcccaataaagcctttttaatggcgctgctggaacaggttatcacccgccaacagaccaccgcgcttatcatcgtgacgtgcgaaacgttgcgtgacacggcaggcgtgctgcaagaaacgcagcgggagattctattactgacgctggttgagaagctgaagtcggtgctggcgccgcgcatggtgcttacgcaggtcagcgggtatgactttgccattatcgcccacggcgtcaaagagccgtggcacgccatcacattaggtcagcaaatactcactatcattaatgaacgactgcccatccagggtattcaactgcgcccaagctgcagtattggcattgcgatgtattatggcgatctgaccgccgaagcgctctatggtcgcgccgtctccgccgcgtttaccgcgcgccgaaaaggtaaaaatcagatccagttctttgacccggcgcagatggaggccgctcaacagcgccttaccgaagagagcgatatccttaccgcgctggataaccatcagtttgccatttggctgcagccgcaggtcgagatgcgcagcggcaacgtattaagcgccgaagccttgttacgtatgcagcagccggacggtagctgggaattgccggaggggctgattgagcgcattgaatcctgcggcctgatggtcacggtgggccattgggtgctggaagagtcctgccgccagcttgccgcctggcaggagcgcggcgtgacattgccgctctccgtcaatctttccgcgttacagctcatgcaccctggcatggtgtcggatctgctggaattgttaaaccgctatcgtattcaaccgggtacgctgattcttgaggtcactgaaagccgccgtatcgacgatccgcacgctgccgtcgctatcttacgtccgttacgtaatgctggcgtgcgtatcgcactggatgattttggcatgggttacgcggggctgcgccagttacagcatatgaagtcgctaccggtcgatatccttaaaattgataaaatgtttgtcgatgggttaccggatgatcacagtatggtgacggcgattatcctgatggcccgcagtcttaatttacaattgattgccgagggcgtggaggacgaggcgcaacgcgcgtggcttggaacaggcgggagtcaacgtcgcgcaaggcttcctgtttgctcggcccgttcccgcggatatctttgaagaacggtatctgtcgcacgaaaatcctgattacaaaagttaaaaaaggtcgcgcttgtgcgagtcagctcaaactttttaacatttttgtttcaattatgatcctggcgcatttctgtcatgttgtgtgggtgttattttaaggccgcaggttactcataaccttacaagacctgtggtttttacttcaaggacaccctatgaaaacctctctgttcaaaagtctttattttcaggtcctgacagcaatcgccattggtattctccttggccattactatcctgaactgggcgcacaaatgaaaccgcttggcgacgcgttcgttaagctcattaagatgatcatcgctcctgtcattttctgtactgtcgtgacgggcatcgcaggcatggaaagcatgaaagcggtggggcgtaccggcgcggtcgcgctgctttactttgaaattgtcagtacgattgcgctgattaacggtcttatcatcgtcaacgttgtgcaacctggcgccgggatgaacgtcgatccggcaacgctggatgcgcaggcggtggccgtttatgccgcacaagccaaggagcagggcattattgccttcctgatggatgtcataccgggcagcgtgatcggcgcgtttgccagcggcaacattctgcaggtcttactgtttgcggtgttgtttggttttgcgctgcaccgtttgggcagcaaaggccagctcattttcaatgtgattgagagtttttcgcaggtcattttcggcatcatcaatatgatcatgcgcctggcgccgattggcgcattcggcgcgatggccttcaccatcggtaaatacggcgtcggttctctggtgcaactggggcagctcattatctgcttctatatcacctgtattctcttcgtggtggtggtgctggggacgattgcacgggtaacgggctttagcatttttaaatttattcgctatatccgggaagaattactcattgtgctcggcacctcctcttccgagtcagcgttgccgcgtatgctcgataagatggaaaaactggggtgccgtaaatcggtggtggggctggtgatcccgacggggtattcgttcaaccttgatggcacctctatctacctgacgatggcggcggtgtttatcgcccaggcgaccaacagccatatggatatcttccaccagatcacgttgctggtcgtgctgctgctatcgtcaaaaggcgccgcgggcgtgaccggaagcggctttatcgtgctggcggccactatctccgccgtaggtcatttgccggtggcgggactggcgttaatcctcggtatcgaccgctttatgtccgaagcgcgcgcgctgactaacctggtgggtaacggcgtggcgacggtggtggttgccaaatgggtgaaagagttagatcaccaaaagctggacgatgtgcttaataatcgtgcgccggatggcaaaacgcacgaaatttcctcctaatctcgccacttatgcccgtagtcccttccaggactgcgggtgtttgcgcataattgacccctgcgcccaaagcatacagcatgatgcttagggattatttcacttcttccgtgacatttttaggttctcgcggtctaacacgaagtgtttttacgtcatattcaggcatccctgccggggctgtctttttattaccaggattgttgatcaggggttcacatgcagggcacaaaaattcgactcttagcgggcagtctgttgatgttggcctctgccggctatgtgcaggcagatgcgctccagcccgatccggcatggcaacaggggacgctggctaatgggttacagtggcaagtgttggctacgcctcagcgccccagcgatcgtattgaagttcgtctacaggttaataccggttcgctcaccgaaagtacgcaacagagcgggtttagccatgcgattccccgtatcgcgctgacgcaaagcggtggtctggatgccgcacaggcacgttctttatggcagcaaggatttgatccgaaacgtcccatgccgcccgttattgtttcttatgattccacgctctatagcctcagtttacccaataaccgtaacgatctgctgaaagaagcgctgacctatctggctaacgtctccggtaaattaaccattacgccagagacggtgaatcatgcgttaagcagcgaagatatggttgcgacgtggccagcagatactaaagagggctggtggcgttatcggctgaaaggatcggcgttattggggcacgatcccgcggaaccgttaaagcagccggtagacgcagccaaaattcaggctttctatgaaaaatggtacaccccggatgccatgacgctgattgttgtcggcaacattgatgcgcgctccgtcgccgagcagatcaataaaacgttcggtacgctgaaaggtaaacgcgaaacgcccgccccggtgccgacgctttcgccgctgcgggcggaatcagtgagcattatgaccgatgcggtgcgccaggatcgtctctccattatgtgggatacgccgtggcaaccgattcgcgagtcggcggcgctgttgcgctactggcaggcggatctggcgcgcgaagcgctgttctggcatatccagcaagagcttactaaaaataacgcgaaagatattggtctggggtttgactgccgggttctgttcctgcgcgcgcagtgcgccatcaacattgaatcacctaatgataagctcaataccaatttgagcctggtggcgaatgaactggcgaaagtacgcgataaaggtttgtcggaagaggagtttactgcgctggtggcgcagaaaaatctcgaattgcaaaagctattcgcgacctacgcgcgtaccgatactgacattttgactggacagcgtatgcgctcgctgcagaatcaggtggtggatatcgcgccggagcagtatcagaagctgcgtcagaatttcctcaacagcctgaccgtcgatatgctcaatcagaatctacgtcagcagctatcgcaggagatggcattaattttgctgcaaccgcaaggcgagccggaatttaatatgaaggcgttaaaggcgacgtgggatgaaatcatggttccggcaactgccgccgctgttgaagcagatgaggcgcatccggaagtgacggaaacaccggcggcacagtaagcggccgcctgtcggcccggtaagcgcagcgccaccgggcaagaacgaatgacttactgcggcatcgcgtcgtgcggaataatggccccacggtactgaatcaccgtgctggccgtcaggtgtccgcgcttcgcggcatccgtcgcgctgccgcccgtcaaacgaacggccagataaccggcgctgaaggagtcgcctgcggcagtggtgtctatcactttctctttcggcagttttactgccggaacgtcaatgagcgcctcgccctgaatcgagaccaggcaagagtccgccccgcgttttaccaccacttcctgtacgcctgccgcatgggtgcgagcaatgacctcttccaccggttgcttaccccatagcgcgtcttcatcgtccagtgtcaggaaggcgatatcagtacattccagcatcttttgatagacctgctgcgtttcttcgcgacttgtccataaacgcgggcgatagttattatcaaaaatgactttcccgccgttggcccggcattcacgcaataaagacagcagcttatcacggctggtcgggcttaaaatcgcgaggctaatgccgctcaggtagagataatcgaaggtcgccagcgtctcgcagatagccgctgactgctcgctctccagccagaatttcgctgccgcttcgttacgccagtagtagaaggtacgctcgccagtgtcatcggtttcgatgtaatagaggcctggcaggcgattttccatccgctgcgttagcgaggtatccacattttcatgctgccacgcctccagcatctgttggctgaaactgtcggtacccagcgccgttacatagtgaacggccagagcggcagaatcgacctgacgggcaatataaacggaggtattcagcgtgtcgccgccgaagccgcgctgaacatcagcgcctttctgcgacagctcaatcatgcattcgccaatcacggcaatctttttagacatagtcgtgaacctgatctgtaaaaattagcgttagtgtgcgctgtggatgtttagcggtcaataatattaaaacatcggtccattatttttttgagcaagtgcgtatttttgacaagtttcgtggtctgtttttattttgccagggaccgagggtaaagttctctgcctgaacgccgataacctttgacgagtccggactgtcacactcccattaacaggacaactgagatgataaagcaggttatccagcagctacgcgttcctgatgcaggtatagagaatttgcaggaacggcgctattggctgcaatgcgagcgtgcctatacttaccagccgatataccagacggatggccgtctgatgacggttgaacttctcactgccgtcacccatcctgataacccttccagacgtattgccccggatcgttatttcgcggaattagcggttcgacaccgcattgacgtagtaaaagaacaacttcatcagcttgaacaaaaagcggattttttcactcgccatcgcttattggcatcagtcaatgtcgacggccctacgctgattgccatgcgacaacagccggacattctggcagcgatggagcgcttaccctggctgcgttttgaactggtggaacatattcgtttgccgaaagactcctctttcgcctcgatgtgtgagttcgtcccgctgtggctggatgattttggtactggtatggccaatttttcagcgctgagcgaagtgcgttatgactacattaaagtggcgcgcgagctgttcgtcatgctgcgccagtccccggaggggcgcaacctgttcattctgctgctgcaactgatgaaccgctactgccgcggcgttattgtcgaaggcgtggagactctggaagagtggcgtgatgtgcagcgttcgcccgcctttgccgcccagggctattttctttctcgacccgtgccgctgatatcgctcgaagaggtgattctgaccctgtaacgccagactgttcccgtaatacgtggtattacgaggtgcggtcatcctcctttttcgtctggctgaactatctttaggacaggcaagggaagaagtgaggaaataacacatgactaaagcaggcaaaataaccgccgccatcacagggactttcttgttgttgatcgccatagtgattttgttgatcgcaacatttgactggaaccgcctcaaaccgaccatcaaccagaaagtctctaccgaattgaaccggcctttcgctattcgcggcgatttaggcgtggtgtgggaacgccaaaaacaggagtccggctggcgaagctgggtaccgtggccgcatgttcacgcggaagacgtcattctcggcaatccgccggatattccggaagtcacgatggtgcatctgccacgcgttgaggcgacgcttgccccgctggcgctcctgaccaaaaccgtctggctgccgtggatcaaactggtgaaacccgacgcgcgtcttattcgtctgtccgagaaaaccaataactggacctttaacctcgcgcaagacaagaatacggaccccaatgctaaaccttccgcctggtccttccggctggataatattctcttcgaccaggggcgaatcgcgatcgatgataaggtcagtaaagcggatatcactattctggtcgatccgttaggcaaaccgttgccgttcagcgaagtgacgggaacgaaaggcaaagcagacaaatccaccgtgggcgactatgtcttcggcctgaaggcgcaggggcgttataacggggaaccgttgaccggtacgggcaaaataggcggtatgctggcgctacgtagcgaaagtacgccttttcctgtgcaggccgatttccgctctggcaatacgcgggtggcttttagcggcgtggtgaacgagccgatgaaaatgggcggcgtcgatctgcggcttaaattctctggcgattcactgggcgatttatatgatttaaccggcgtgctgctgccggatacgccgccgtttgagaccgatgggcgattggtagcgaaaattgacgccgaaaagtcatcggtatttaattatcgcggttttaacgggcgcattggcgacagtgatatccacggcaccttcacttataccaccggtaaaccgagccccaaactggaaggcgatgtcgaatcgcgccagttacgcctggccgatcttgggccgctgattggcgtggattccgggaaagacgctgagcagtcgaaacggtctgaacagcgcaaaggcgagaagaatgttcagccggcggataaagtgttgccttacgatcgctttgaaaccgacaaatgggacgtcatggacgccgatgtccggtttaaaggccggcgtattgagcatggcggcagtctaccgattagcgatctttcgacccatatcatcctgaaaaacgccgacttacgtctacagccgctgaagtttggtctggcaggcggcagtattgtctccaacatccatctggaaggggataaaaagccgatgcaggggcgggcggatatacaggcgcgtcggctgaagcttaaagaactgatgccggatgtggagctgatgcagaaaacgctgggcgagctgaacggcgatgcggatattcgcggcacgggcaattcggtcgccgcgctgcttggcaacagtaacggcaatctcaaattattgatgaatgatggattgattagccgcaacctgatggaaatcgtggggctgaacgtcggcaactatattatcgggcagatttttggcgatgacgaagtgcgggttaactgcgcggcggcgaatctcaatattgcgaacggcgtggcgcgaccgcaaatttttgcttttgatacagaaaatgcgttgattaacgtgaccggtacggcgagcttcgcctctgaacagctcgatttaaccattgatccggaaagtaaggggattcgtattattacgctgcgatcgccgctttacgtgcgcgggacatttaaaaatccgcaggcgggcgtcaagcccggcccgctgattgcgcgcggcgcggttgcggcagcgctggcgacgttggtaacgcccgccgccgcgctattagcgctcatttcgccctctgagggcgaagccaatcagtgccggacgattttaacgcagatgaagcagtaacgtgaaacgtcgcgccggatgacgccatccggcgccctattacaacgcctgatgacgcgtctcatgggttaacagcagtgcaatcagcgtcagcgccgccattgacgccaggtaaacccctaccgccgccagcccgtagtggctttgcagccatgcggcaatatacggcgcgacggaagcgcccagaatcgatgacacattgtaggaaaacgatgcgccggtatagcgtacttccgtcggaaatagctccggcagcagcgctcccattgggccgaaggtcagccccatcaggctcagacctaacaacaggaacacgaataccagcgctggattgcctgaacccagcagcggggtaaaggcgaacaacgcgaagagaatgatgagcgtggtaatgatgaccatgcttttccgacggccaaatgcgtccgccagcaggccggcgacgggcaccatcacgccgaaaccaatcaccgccatcatcagcatccacagtatttcattgcgcggcaagccaagccccaccggcgcggcggcagtgctgtaagtcatggaatagacggtcatgatatagaacagcgtgtaggtcgccagcatgataaacgtgccgagaatggttacgtggacatgcttcgtcagcaacgtgcccagcggtatttttacctgctttttcgctgcggcgactttcgcaaacaccggcgtttcatgcagcgacacgcgcacatacaggccgataatcaccagtaccgccgagaagataaacggcacgcgccagccccagctcataaattgctcgtcggtcagtagccaggagagcaacgggaaggtgccattggcaaaaaagaagccgatcggcgcgcccaactgcgggaaggagccatacagcgcgcgtttgcgcggcggcgcattctccgtcgctaataacgctgcgccgccccattcgccgcccagccccagtccctgaccgaaacgcgccagcgccagcagcagcggcgcgaaaatacctatcgtcgcgtagcccggtaacagaccgataatgaccgtggagatccccatcgtcagcagcgaagccaccagcgtgactttgcggcctacccggtcgccgaagtgaccaaatagcgcagagccgatcggacgcgccacaaacgcgatagcgaaggtggcgagcgattgtagcgttgccgcagtgggatcgccctgggggaagaagataagggggaacacgatcaccgctgcggtggcgtaaatatagaagtcgaagaactcaatcgcggtgccgataagcgaggcaataacgactttattgcgtgagtttaccggaacatgttcctgctcatggtcgagtgttgtggcggttgcttgcatactattttcttatttttagcgaacgaatagccatattacgcacagcaaaagttatatttcaatgtgtaacaaaagccaaaaatggtcaaaaaaagcgcaaaaaggggataatgtttaagccagctattttgcgtctatgaaatgcttcacataattttaggattggtggataaaactggtttctggttaaataaaagttaattaccggattgatatgctgaaacaatgagatgaggcggaaggacgtgcctgattgtaccgccgggtacgctttacatacctggcctgggtccatacagcagtaggccgaatgacgacgccgtgcgtgccattcggcagcaagccgcagactagcgttgcgttttacccggcattcgcgggtcgtccttatattcggcggtggctatccaggccgcgcagaataacgtcaggcgggcaaaaaagtagaagaatgccatcagaccgagtacggagccaaacgccgcgccggaaggcgatttcaccagtgacggcagcgtataagtcataatgattttaatcacctcaaaaccgatagcggcgataaatgtcccgcgaatcaacgcttttttacggggacgatggcgaggcagtcgccagaaaatccagaagaaaagcagatagttggcaaaaatagagatggccagaccgatcaaatgccaggccggttttaaccattcgatgctgtcgagatacaaggcggagatgatcatctgctgggcggaaccggcgatggaagtaatggacagcgtaatgattaaagcgattaataatccaatcagcgagataaaatcgcgcagatatttgagccagattttctcctgatcctgcggcttgcgctcccagacgtcccgtgactgggcgcgaatcgcttcccgcaggttgcccatccagttaacgccggaatagagcgcgatacccagtccgaccagccctaccgtggtacgctgttgaaccgccgtattaatcgtatttttaagcgtggacgccagcgtaggatcgctcacattcatcaatatcttgctgaaaatatcttccagtagattagggtgcgaggcgaggataaaacctgccgcggcaaaggacaccatcattatcgggatcatcgacagaaacgaaaagtaggtgatagccgcgccaaactgattacccagtcgatcgttaaaacgttcggtcgcgcgaatgaggtgggccaccatcggttgacgctgtattttttgcatcagggtggtgacggaatgcaacgcctgatttgccttttcgtttttttccggggcgtcatgcggctgcgtttctattttttgtatcgggtcgtgctccagttcctgaatagggcgttttacgtcattttcctgcgtcatcaggtcggtagtccttcatcattaatagaatatgtcagtatagcttctccccggtggatgctgaaaatgcggctactctgcggcctctttaatggtttcagtcagccataccataaacaggtgtacccggcgggaaagattacggcgatggggataatgcagcgtcaccggcagtggagcggcgcgatattgcggtaaaatttcaatgagcgctccggcgcgtaacgcctcccgtacagcaatgcgcggcgtctgaatgatccctaatcctgccagacaggccgtatgccaggtctccgtactgtttaccgttagcattccgccggtttttacccactgcataccgtggggagtttcgaaggcaaaacccggtgaagagactcccggggtcaatgaataatgcaccatcgcatgtgaggcgaggtcgtcaaggttttctggatatccaaagcgcgccaggtattgtgggctggcgcagttcacccttcttagtttgccaagcgggcgcgtcagtatccctggcgcatgtagcggctctgtgcgcaccacacagtcgaaatcttcccgtagtaaatcgacctgtcgatcgctactacaaagttccagcgcaatgccgggatactgatgcaaaaaagtgagcaggcgcggcatgataaggctgtttgcgagacctggcgggatatctacccgtattttgccgctgatactggcgggatcaggctggaaaagaccctccagttcatccaggttactcaacagatcttttgcccgttcgtagtaaaccatcccgtcctgagtaagctgtacccgccgggtggtgcggtggagcaggcggatgcccagttgatgttctaacgcttgtatttgccgtgagacgctgcctttgggaaggccgatatcttctgctgcgcgggaaaaactttcccgttccgccacgcgcacaaacaatttcattgcatatattttatccatcatcaggctctattattgtttttattgaaacagtgacgctgaagcggctggttttattgattttctagcatctaataagccctttcgcaatcattgctcgcgtgacgaatacgtctgatcgcgttgcgcggcggatttatcgccttccggctaggcattttagcgccaaaaagccgataaacgggacgagagcggtaaaacacgctgatagccgcgggtgtagtgggagagagaaatgcatgtacatatacggtattgtcattgacccatcgtcgcggttttcaggcggattggctattttttaacaaaatgtgctactttattttttgtaacacataaggcgaaaagcagatatttcctttgtgacgcgccaggcgtactcttcattaaattaatattcaaattagccctgtctgtttgtactaataagatattccttactttaaaacgctaatgttagcgaattctgtaatcccgatgttgaagctgtaaatattcataacctttctcttcctcaaccaatgactatcggtaaaatggcctataccaaatggcgacttcttattttaccctacgggtaatacccttcctcatcttgagactattatcttacccaggtggagaaaagtaatgcaggtaatcatgtttgacaggcagtcaatatttattcatggaatgaaaatcagtttgcagcagcacattccaggaataagtatccagagtgtcggtcaggcagaagaactctggcaaaaaatagaaagcgcgccggatgcgctggtcatgctggatagcggcctggatgctgaattttgccgcgaggtgttacaaagaaccgcgcagcaatttccggaggtgaagattattatcacggcgatggatggcagtcaaaagtggctgcatgaagtcatgcaatttaacgttcaggtcgtggtgccacgcgattctgatgccgaaacctttgtccttgcgctcaatactgtcgctcgcgggatgatgtttttaccgggggattggttaaattcaacggagctggagtcccatgatataaaagcgttaagcgcccgccagcgggaaattttacagatgcttgccgcaggagaatcaaataaacaaattgggcgggcgttaaatattagtaccgggacggttaaagcgcatctggagtcgctttaccggcggctggatgtaaaaaatcgtacccaggccgccatgatgttaaatgaatcgaattaacgacgttaaattcgcagtccgcttatttctggctgtgaaatatcatccgtattgattaatgataaaaaacgctgatgtccgatgctgaacatcagcgcaataagcgtttcgcgttgaaaccgatcgttaagttccggcaagcaattctgtagcagcatatcgcagctattgaggtcatccagcaagaatgcctccgcctggtcgggcgtaatgaacgtcagcgtctcatccggcgtcaacatatgcccgtaaccaatcacccagttaccctgccgatcgcgatacttttccagcgacagaccctgccactgtttaataaacgcgatgcaggcggagctaaagcgagatgaaatgtgcggcatggcatctttctcataaaaagcgcgattataaagtgtgctgcacgcgtggctagcggtcagacggccaaacgcaggcagggaaaaggtctatgccgttcagcgtcacgccgcgttgacagaatgaaaaactgatgtttttggttagtaaccgatcttcttataaatttgcaatcattaagattaagtcactgaaatgtggctaaatctgttatatctatgaaaaaacataattaaaagaaaacgaagatctcgtcgcgggatcgtctttttagggaagataatgacgaatagcgcttcgcaggcgacacgcgcgccttttgaacatagcctggggattatccgccaggcatcaatagaaatcctgctgctgctgggtattcataccacagagggaaaagagccccggtggttcatggaacaacttgagcaggcgcgtcttaacctgggcggttggggcgcggtggcgaaaaaattgcggataaatgacgcgcagttgagccagtttatgctgcaactgcgtcatcttcagcagcatgttccccagtatgacagcgggcaagaggtgagcgaaaatcaactccttgccgcgttgcgttttgtcacctcgctggaacatctacgtcagcagcagccgctactgacgtatcaaactgagctggaagaccccgaccaggaggcgcatcttgaggcgcagcgtcagcttcgggcgatagaactgacgttaaaagcgcttattgcgcgcgcatggccggatcgggcgtccctgaatcactacctcaagcaacattttggcccggaccgtttgcgccagtggttaaaacagggagaagatcaacatgcgctggagggcatgttgtttagcgaactggcgcttatggtggtcgataaaaaattgtttgctcgtcattacgtcagaatttttaatgacgcctcagcgttaacgctgttcgccgagtcgcgcaccactctgcgtatgtttctggatgattgccgcctcgcgcgaaacgaggttatcgccaggcagccgctcacctcagcgcagcttatgctgctaaacgttcagtatcagcaaatcgttcggcccatccagcgcgcctatgccgaaaaacgtacccgcgtgaatcccgcttcgtttctgctggcggatgaacgtgaattgcgccagttctgggaaaccgcgcggcttaaagatcggcaggccgggggagataagcatgagattagcgagagcatagaaccaccgcgtaagcggcctccgcgtacgcctgaagagcgtgagcaacttatttccggcgctttgtggggcggggttggcgtcatgacgctggcgatactggcgggcgcgttctggctatttagttcgtcatcgccaagctccgataacgggcaagctcccgcaatggcgcaggatgaaccgccgcgcgaggcgccttccgcgcgggaaacgctcaatcatatggggattacctgggatgcgtttaccatgcgggcggcgatagagcgcaatgatacgcgggtgacggcgctgttcctccagggcggaatgaactggcagctcgcgtggacggagcaggcgtttgcggcaggacataccgaggtgctgcaactgttgttgcgttatcccgcgctgatggatgaggtcaaaccctgccgacgatttatcacaacgttaagtcatgacatgtcgagcggcgcgccgctgaccgcgatgcataaaacctatttgcaaacgttttgcaccgttccggctgttgtgacgcgccagcagtacgatacggagcaggcccagctgcgcgctcaggcccggcccagcgcagacaataaaaaatggctgaaaattcagtcagccatttatgatgcgattcactgagcccggagcaggttaaggctctccgtaaaggccaatcaggcggcgcaccacgccattggtccagccgaacccatcctgtagcggatactcgcccccgccgccttcgcggggcgtaccgccggaaatatggtatttctcgatcagtttatggtgctcctgataaaaatggttcaccgtttttaaccagttatgggcgatttcatcgcccagcatatcgtcgccataccgtttgaagccctgaatcgccatccattgcagcggcgcccagccgttcggtttatcccactgttcgccggtttcgtattcggtcgccataatcccgccgggcgttaacagacggctgcgtactacatttgccagacggtcggcctgctcatggttcgccataccgacatacagcggcacgatactggcggcggaaaagagcgccatttcttcgcgtcgccagtcatagtcccgataacagccgttttcatcatcccacaaataatggttcacggcggcgcgtcgatcgctggctttctggcgaaatagcgcctcggtgtcacgttcgcctttcagcgctgaaatattggcgatagcgctctccagtttatacagaaaagcgttcaaatcgatagggataaactgagttgtacgtatgctggcaagccggcccgcatcgcgtagccagcgtgaagaatagtcccagccggacgccgccccggcgcgcaaatcccggtagacttcattgggcggacgaccggaatgttttgcggtttcgacatcttccagccaggactcgtcgcgcggcgtgtcgcgatcgtcccagtagcggttcagcagggaaccgtccggcatccgcacaacgtggcgataagcctggttgagcgccagcgattcggcgccgtccatccagaaggcgtattccattttgagatggtcgagataacgccgcgcgccgcgcacgccatcttcttcgaacagttcaaccatcagggcgaaaaccggcggctgcgagcggctcagataataggtgcggttgccgttgggaatatgaccatagttttcaatcatccaggcgaaattatccgccatacatttaagtaagtcttcgcgcccgctttccgccagacccagcatggtaaaataagagtcccaataataggtttcgctaaaacggcctcccggcacgatataggattgcggcagcgccagcagcgaagaccacggaatatgatcctgcggttcgcgcgtcagtatcggccaaagctggtcaatatgttctttgagcgagttttcggggttagagacatactcgctggataaggtttccggtagccagaaatggttctcgacgaagcggcgtaagtcaaaatcacggtggcgtctgaccttacggtagcggatcaggatatcaagcgggtccatcttcggcgcgcagtccgggaacgttttactgtctggaaacagttttgttgactgtacatgctcgaacagttcgagataccgatcggcaggggtcagggcgtcagaggcgggaagcccctcgatcatctccggctccggttccgcctcgatcatttcatccagctttaactcgcacgggtctgtttcataaaacagatcgacatcaatagtcagatcttcagaaggcgtggggtttaatttctggttgagcataatgacaaggacctccggcttgcgtcgtaaaagatacgggtgttgcccggctgtctattaagcgtagacattcgcttcgatacctgagtggcaaagtgtgcggtagatcacattttgcaatttatctctcaaaaaaacacttcataacttactgaatagtattgcgaaaatcctattttcatgacgcctccctcagacctaaaatcagaacattcgtttcatagtggtatcactacgtcaccacatggcgtggattcacaaacaaaggtaacgtaaatagttataatacaagctatggcaccatgataatacaaatggatacaaatgatcgagcaacccgacagtaaaagcgccaaaccgctttataagcagcttgaagacgccttaaaagaggctattgcgcgtggagagtataaaccaggccagcagatcccgacggaaaatgaactgagcgtgcgctggcaggtgagcagggtcacggtccgtaaggcgctggatgcgctgacgcgtgaaaatttgctgacccgtgtctccggcaaaggcacctttgtttctggtgagaaatttcagcgtagcatgaccggcatcatgagtttcagcgagttatgccagtcccagggacgtcgcccggggtcacgcaccatcaaatccgtttttgaatcggtagacgatgagacaaaagcgttactgaatatgaacgatggcgaaaaagcggtcgtcattgaacgtatccgctatgccgacgatgtggcggtatcgctggaaaccgtacatcttcccccacgttttgcgtttttgctggacgaagatcttaataatcactctttgtatgaatgcttacgcgagaaataccatttatggtttacccactcccgtaagatgatcgaactggtttatgccagctttgaagtcgcccattatcttggcgttaacgagggttatccgctgatcctgataaaaagtgaaatgattgataacaaaggagaactctcctgcgtttcgcaacagttgattgtcggcgataaaatacggtttaccgtatgatgtcagcattacgctaacgaagagcaggctgaatcgggatccagatcgcggatcccgattttttttggtttccatcttgatcaaatgtctttaaatatcatataaaaataataatacattatgagtcatttatggcgaatcctcgcctgtatcattgatggaaccagaggaaagcatgatgggtatgaaagagacagttagcaatattgtgaccagccaggcagagaaaggaggcgttaaacacgtctattacgtggcgtgcggcggttcttatgcggcgttctatccggcgaaagcatttttagaaaaagaagcgaaagcgttgactgtcggtctgtataacagcggagaatttattaacaacccgccggtagcgctgggagaaaatgccgttgtggttgtcgcctcccacaaaggtaatacgccagagacaattaaagcggctgaaatcgcccgtcagcacggcgcgccggtcattggtttaacctggataatggattcaccgttggtggcgcattgcgactatgtggaaacgtacacgtttggcgacggtaaagatattgccggagagaaaacgatgaaaggcctgctgagtgcggtcgaactgctccagcagacggaagggtatgcgcactacgacgattttcaggatggcgtcagcaaaatcaaccgtatcgtctggcgtgcttgcgagcaggtagcggagcgtgcgcaggcgttcgcgcaggaatataaagacgataaagtcatttacgccgtcgccagcggcgcgggctatggcgcagcctacctacagagcatctgtatctttatggaaatgcaatggatacattccgcctgtattcatagcggtgagtttttccacgggccctttgaaattaccgatgcgaatacgcctttcttcttccagttttccgagggcaatacgcgggcggtggatgaacgcgcgttaaacttcctgaaaaaatatggccagcgatattatcctgaaactttcacagaaggtgaatgcgttattggcgcgggatgatgttgacggtgtggtcattactcatggcactgacacgctcgatgaaaccgcctactttcttaatttgaccgtgaaaagcgacaaaccggtggtgtttaccgctgcaatgcggcccgcgtcggcaatcagcgccgatggcgcaaggacagccagggctggtgtctgactcgctcaacccggcgaaggcgcgggtgttactgatgatggcattaactcagacgcgtaatccggaactgatccagagttatttcagtacgtattaatcatgaaggcctgtgcgcccaccctcgaagatgggcgcacaagatattaacgcatggtcacaaactcttccgatgcggtcgggtgaatagcgacggtattatcgaagtctttcttggtagcgcccatcttcagcgccactgcgaagccctgcaacatttcatccatgccgaagccgataccgtggatacccacaattttttcttccggcccgacgcagaccagcttcatacggcacggctggcggtgcgtcgtcaccgcggtatacatagcggtaaacgatgatttatagactttcacctgctcgtcgccgtactgctcgcgcgcctgcggctcgcttaacccgacagtgccgataggcggatggctaaagaccacggtcgggatgttgctgtagtccagatgctcgtccggcttgttgttaaacaggcgctcggagagacggcgaccggcggcgacggcgactggcgttagttctatcgcgccagtattgtcgccaacggcgtaaatgccttctacgttcgtgttctgccatttatcaacgatgatgtaacctttttcattggttttcacgcccgctgccgccagattaatattgtcggtcgacggttcgcgaccaatggcccagatcaggcaatcaacggtttcactgcggccatcttccagttccagagtcagactgccgtcggcgtttttcaccaccgctttcggcacggcgtgagtatgcagttgcgggccttcggcgttcatcacctcaaccagcgtttcgctaatcatcgggtcaaaactgcgcagcggcgcatgtttacggacaaacagatgcgttttcgcccccagcgcgttgataacgccagccagttcaacggcgatataacctgcgcctaccaccgcgacgcgctccggcaaggcagatagcgcaaagaaaccgtcggaatcaatgccgtattccacgcctggaatgctcggatggctcggacggccgccggtagcgatcaaaatatggtcagcggtgatggtttcgccgttcacttcaatggttttggcatcgacaaagcgggcaaagcctttaatcacatctacgttatttttgcccagcacgttgtcgtatgaagtatggatgcggtcaatatacgcggtacggctggcaatcagcttgctccagtcgaactgattaatcgtggtgtcaaaaccgtagtccgggccatacagatgaatcgcttcacgaatctgcgcggcatgccacatcactttcttcggcacgcagcccacgttaacacaggtgccgcccagctctttggcttcgatgagcgcgcatttctggccgtacatagcggcgcggttaatcgaggcgataccgccgctgccgccgccgatagcgatgtaatcatagtgtttggtcatgaccgctcctttatgttcgttgtcggacggatagattctgcgctacccgccaaaatattcgcgattgtatacctgaaggtgaaaggttccaccgatggctgtgattactccggcacgatccagcttaccgaagtgtgtccgtgaccgtttggcgccaacctgctgtgcagccacggtagcacgttgttcatctgctgctccagtttccacggcgggttaaccacgatcataccggacgccgtcatcccgcgctgatcgctgtccgggcggatcgccagctcaatttgcaggattttacggatgccggtggcctccagctcatgaatcatgcgcttaatttgctggcggagtaccaccggataccatagcgcgtatgtaccggtggcgaaacgtttataaccctcgctgatgccgctgactaccgcctggtaatcggttttcatttcataaggcgggtcaatgagaatcagaccgcggcgggaaaccggcggcaatttggctttcagttgctgatagccgtcagcgcgttccacgcgggcgcggttgtctttttgaaactccgcgcgcaacagtgggaagtcgctgggatgcaattccgtgagttgcagactgtcctgctcacgcagcaactggcgggcgattaacggggagcccggatagtagcgtaactgcccgctgcggttgaaatgttttacgacgctaatatacggttccagttcggcgggcagatcgtcctgctgccagatacgggcgatgccttccagatactctccggtacgttcagcatgttcgctgcccaactgataacgccccgcgcccgcgtgcgtgtccagatagagaaacggtttttctttctcttttagcgactcgatgatcaggctctgaacggtatgtttaaggacgtcggcgtggttgccagcgtgaaagctgtgacgataactgagcatggatgcagatattccgggaagtaaacaagttagccgatagtttaccgcagatccgtagagattaccgctcttgcgcttttatcgccgttggccaggaggaaaaacaagtaggctgtggcgtcagagcgtaaataacgtcaacgaagtgatgcaggcgtctggattggcctgtttcacggtcttaaggaaggtggcaaaatttcgattgaatagggtgtagttatgaaggaagcgcgtctgttttctttgcccttccgctgttatccagtcgactgaccagactgaacgaccactgactctcgttgttcccggtttcgcctcaataatgctggtgagtggtatcgcggtggtgataccgtccgcgacctcatagaggtactgcatgtcaaagtagtaatccgcgttatagccgcgagaactgccaaattttcgcagcatcagcgaagaagatgaaattaatttacggccatcttgcagatgcttactccgacggaaaatttttcgcccagggaaaataaagaaaacaataaatatcagtacaataacctgtaataacgtggtcatatacaatccttgtattccagaaacgaaaaagttgagaatattatacatgggcagtttgcgcaaaaatgacagcgattgatgtcacggccctgttttcagaaaaacacccatgaaaagcctatctgaatttaacgctaatcatgccgcgacgcgtccaccgacttacccctgtcgggtcttattctgaaatcgtttttattatgatgatagtgctggttttaccttgtttatttgattaaaacgatagcgctaataatagaaaagaaaggattcattgatgttccattatggaaaatgtgtcgttcgcacgttgtttttattactggtttgctgttcgctgtcgggctgtctttcatttgggctgatacttgccaccgataaagatggcaatcgtcatcagtctacctggaaatcggataccgttaccgcgctttccttaggtaaagatagcaacgggaaaacgggctgggtgtttgttggcgaacattttgactacctgttgacccagggcggcgataatgtggtggcgctgttaaaagatgcgactattcgccgggataaaatgcgagtaaaggatggtgttaaattcctgattgatacagataagaaggagtttacgggtgaagtcaatgtgacttacgcctgggtggacgagaaagataaactggcggcggtaggctacgggtttatttgtgcagacggcgcggtaaattgcacgctatccgtcatggacctgaaagggactatccatcagaaaaataaagagcagagcgttacgcagcagctatcgttctatcatcctttcaccgttgagttctatcagtatcagcgcagtatgtccggggcaaaatttggcagagtgttgctgccggtaactttggcgctggatattgtcactatgccgctacagctactgatcttcagtcgttaaaattggattcagcagcaatgcctacgttcggatgctggcgttgctgcacgggtgaaatgagcgcccaccatcattgaaattcccccaactatcccccattctagatccatagcgaaagcgcgatagagcgcttcatttcttttttagaccaggactgcgcatatgaccaatccattactaacgtctttttcactgccgcctttttctgcaattaaaccggagcatgtggtgcctgcggtcaccaaagcgttggccgattgccgggcggcggtagaaggcgttgtggcgcatggcgcgccgtatagctgggaaaacctctgccagccgttggcggaagccgacgatgttctggggcgtattttctcgccaattagccacttaaactcggtgaaaaatagcccggagctgcgtgaagcctacgaacagacgttaccgctgctgtcggaatacagcacctgggttgggcaacatgaaggactgtacaacgcgtaccgcgacctgcgcgacggcgatcattacgccactctgaataccgcgcagaagaaagcggttgataacgcgctgcgtgattttgaactgtccggcatcggcctgccgaaagagaaacagcagcgttacggtgaaattgccacccgcctgtctgagctgggcaaccagtacagcaataatgtgctcgatgccaccatgggctggacgaagctcatcaccgacgaagccgagctggcgggaatgccggaaagcgcgctcgccgccgctaaagccctggcggaagccaaagagcaggaaggttacctgctgactctggatatcccgagctatctgccagtgatgacctactgcgacaaccaggcgttgcgtgaagagatgtatcgcgcctattccactcgtgcctccgatcaggggccgaacgccggtaagtgggataacagcccggtgatggaagaaattcttgcgctgcgccatgaactggcgcaactgctgggcttcgaaaattatgcccatgagtcactggccaccaagatggcggaaaatccgcagcaggtgctcgatttcttaaccgatctggcgaaacgcgcccgtccgcagggggaaaaagagctggcccagctgcgcgccttcgccaaagccgaatttggcgttgaggaactgcaaccatgggatatcgcgtactacagtgaaaagcaaaaacagcacctgtacagcatcagcgatgagcagctacgcccgtacttcccggaaaacaaagccgtgaacggcctgtttgaagtggtgaaacgtatttacggcatcaccgccaaagagcgtactgatgttgatgtctggcacccggaggtgcgtttcttcgaactgtatgacgaaaataacgagctgcgcggcagcttctaccttgacctgtacgcgcgcgaacacaaacgcggcggggcgtggatggacgactgtgtcggccagatgcgtaaagcggatggcacattgcaaaagccggtcgcttatctgacctgtaatttcaaccgtccggtgaacggtaaacccgctctgtttacccatgacgaagtgatcaccctgttccacgagtttggtcatggcctgcatcatatgctgacccgcattgagaccgccggggtctccggtatcagcggcgtgccgtgggatgcggtcgaactgccaagtcagtttatggaaaactggtgctgggagccagaagcgctggcgtttatctccggccactatgagaccggcgaaccgctgccgaaggaactgctggataaaatgctggcggcgaaaaactatcaggcggcgctgtttattctgcgtcagctggagttcggtctgtttgatttccgtctgcatgcggaatttaacccgcagcaaggagcgaaaattcttgatacgctctttgaaattaaaaaacaggtcgccgtggtgccgtcaccgacatggggccgtttcccacatgcgttcagccatatctttgctggcggctatgcggcaggctactacagctatctgtgggccgacgtactggcggcggacgcttattctcgctttgaggaggaaggcattttcaaccgtgagaccggtcagtcgttccttgataacatcctgactcgcggtggttctgaagagccgatggaactctttaaacgcttccgtggccgtgaaccacagctggacgcgatgctggagcattacgggattaaaggctgattttacgtgcaaatctgcttaatggatgaaacgggcgccacagacggcgccttatctgttctggctgcccgctggggactggagcatgacgaagacaacccgatggcgctggtattgacgccgcaacatctggagctgcgcaagcgcgacgaaccgaagctcggcggcatttttgtcgattttgtcggcggcgcgatggcgcaccggcgcaagttcggcggcgggcgcggcgaagcggtggcgaaagccgtcggtatcaaaggcgattacctgccggatgtggttgatgccacggccggactggggcgcgatgcgtttgtgctggcgtccgtcggttgccgcgtgcggatgctggagcgtaatccggtggtcgccgcgttgctcgacgacggcctgacgcgcggctacgccgatgcggacattggcggctggcttcaggagcgtttgcagttgattcatgcttccagcctgacggcgttaaccgatatcacgccgcgcccgcaggtggtctacctcgatccgatgtttcctcaccggcagaaaagcgcgctggtgaagaaagagatgcgggtgtttcagtcgctggtggggccggatctcgacgccgacggactgctggaaccggcgcgtcagttggcgaccaaacgcgtggtggtcaaacgtcccgattatgcgccgccgctggcggatgtcgcgacgcccaacgccatcgtcaccaaagagcatcggtttgatatttatgccggaacccctctgacggagtaacggattgcccgatggcgctacgcttatcgggcctacgattctcaattatttgtaggccggataaggcgtaagccgcatccggcactgagtattactgttcggtaccttgcgtattaatcattcggtttaaccacggcaccataatggccatcaccacggtgaccgccagcgttaccagaccaattttgctaaagacgccggtataaatgggcagcgtctgtaacggatcggtgatgttttccggtacggcagtgaaggtcgccacataaccgccgagcaggaaggcggcggcctgggtcaggaaccacattcccagaataaagcccatcagatgctgcggcaccagagcggcgaccattgccagtcccagcgcgctaatcagcaactcgcccagaccctggaacagatacactagcacgataaaccacggcgacgtcaatccttgcgcatcggcaaaccacatcccggcggcggcggtcagaaaacccagcgcgcagaggaacatgccgagcgtaaacttcatcggcatagtcagatctttgcctttgctacccagtcgggtgtaaatcgctgccagtaccggactggcgacgaccacccagaatgggttcagcgcctgaaaactcaccgggttaatggcgaatccaagaatttcatgatgcacgttattaatcgcaaagaagttcagtgaggtaggcatctgcgcatacagaatgtaaaacagcacggcttcaatcatcagaataaacgccacgaacattttattgcggccggttttatccagacgaaacgcttcgcgaaagaagaaaatagtgacgacgatagaaaggacgatgagcaccagattggcaatcttaacgttgtgcatcagccaggcgcagaggaaaatcatgacgacggtgccgagtagtaccagcagcaaattgcgaaaacgtagcggtttatgatccggttcagaaccgatatttttcaccatgccacggcaggcgaagtacaccagaagcgcaacaattaaaccagcgccgcacagattataggtcaccgcatagccaaatttatcggcaatcaccggcgccagcgatagcgataacaaagaaccgatgttaatcgacatataaaacagggtgaaagcgccatccagccggggatctttaggctgatagcatttagagagcaggctggcgggattggctttaaataacccgttgcccacggcaatcgtacccagtgcgataaaaatcagatcgggatttaatagcgacataccagtcataaaatagccaatcgccagcacaatcgcgcccaggaccagggtgcgtttagtccctaacagatggtcgccaacatagccgccgatggagatcaggccataaaccagcgccgcaaaagcgccaaaagtaataaaggcctgttcctgagaaaaacccaattgtttaacgaaaaagaccgccaggatgccctggacgccgtaatagctaaatcgttcccataattctacaaaaaagatcatgaagaatggacgaggttgctgcagcaagcccgtaggtgcagttgtattcatattccttcgccttttaatgccatcccgaaacgtatgaacgcgtatatcaaaacgcgccgaaaagtcttaccctgatatagactgcggttattagcctgatcaataggttattatacaaatgatacgcaaactaattagtggatcacactaattatgtttggtgtgatggaatgatgtactgagtactgcgaagaaggggggataaacaaaacgcccacataagcgggcgttgttgttgatagccggagtttgcctgatggttcaggccaacctgattgactatagaccagatgcggtcttagccgccagccggcacggtaagtattactcttcttcgtcgcgcagcggaacaatcagcatgtcaacgtgaacggtgttgatcagctggcgcgcagaagacatcagtttgctccagaagtcctggtgatgaccgcaaacgaccagatccatatcgtatttcttgatggcgtcaaccagcacctggcccaaatcgccgctaccgctcagggtttcagtgatagggtagccagcgttggtagacagctcggtcagcgcgtggtgggtttctttggagatacgtttctgcatatcgcccagattgacgtcaatcagaccggtgtacaggtctgaatagttcacatcaacgtggatgagggagattttcgcgttgtaggggcgcgccatagagaccgctttttcaaccagaactttactttccggggagagatcaactgcgataagaatgtgtttataagccatagtgttactccttccataagttgtcgatgaccattgagctactggcgtttcttatgccgccgcgtcacccgcgtcctgcgaactctatgcgcggggctagctcagccgtttaccataactatccttacattatagcgaccaggataatccgtcaatctgccttgcttgccagttagttaaacaaaattttcagggaattgcattgatagtgattaaccttctggtaaaaaaattaactgatctcctacaatgtgtataagagccgttcgaatgcggagcgctaatatggacggctttcgtagtactctttcactgattgtctggcagggtatcggggagcggtagtcccggagaggaactccgtgggcgggtcgccggggaggagatatgataagcaccgtctcactattctgggctttatgtgtcgtttgcattgttaatatggcgcgctatttctcatcgctacgcgcactgttagtggtacttcgtggttgcgatcctttgctctatcaatatgtcgatggcggcggcttctttaccacgcatggtcagcccaacaaacaggtgcgcctggtatggtatatctacgctcagcgctatcgcgatcatcatgatgaagaatttattcgccgttgtgaacgcgtgcgccgccagtttctgctgaccagcgcgttatgcggtttggtggtggtgagcttgattgcgctcatgatttggcactgaataaaaaaagcgggccagtttcctgacccgctcgtattagataagcctccggatgacgccgcttgtagcggcctgtcaggcctgtgtcgtttcatcctgacaggccggattagcgacagcgctatccggcccatttggcttaaataatcttcagggaaagccagtacagcacgccggaaagaataatcgccgccggtaacgtaaatacccaggccatcagaatgctggtcacggttttacgctgtaacccgccgccatcaacgaccatggttcccgccactgaagaggagagtacgtgagtggtagaaactggcataccggtgtagctggcaagaccgatagagactgccgccgtcatctgcgccgacattccctgcgcatacgtcatgccttttttaccaattttctcgccgatagtggtcgccacgcgacgccagccgatcatcgtaccaatacccagcgccaacgccactgccataatgatccacaccggcgcatactcaatggtgcttaacatatcggtcttcagctttttcagcaggcgctggtcatcgctgcttacgccaggcaatttcacgactttgtcggtcgtgtcggaaatgcacagcataatgcgacgcaactgactacgctgttcaacgcttaacttgtcgtagctttccacgtttgccagcatccctttcgcacggttaagcgcgttaatggtgttagccggatggcagtggaattcagtcggttcagtcgcgcccggttccggagagggaatcagttggtcaacgccggtgacggctttcagcaggtcaggacgctgctcaaagtacgtttcgacattgttgatagcatcgcgcgtacgggtgatttcgtagctggaggcattcatattgaccacgaaacccgcaggcgcgacgccaatcagcaccagcatgaccaggccaatgcctttctgaccatcgttcgcgccatgcgaaaacgccacgccgatagctgagaggatcagcgcgatacgcgtccagaatggcggctttttcttgccgtctttcttttcacgttcggctggcgtcaggtggatacgggcgcgtttcttagtaccgctccagtagcggcgcagcaagaaaatcagaccgccggcgaataccagaccgacaataggggagataatgagtgaaccgaaaatattgataactttcgggatgttaagcgcatccaccactgacgtgccggtcatcatcgcattggttaaaccgatgccgataatggcgccaatcagcgtgtgggaactggacgccggcaacccgaaataccaggtaccgaggttccagataatcgccgccagcaacatggaaaagaccatagcgaggccgtgcgcggaacccatgttgagcaggagatccgtcggtagcatatgcacaatggcatacgccacgctgagaccccccagcaaaacgccaaaaaagttaaacactgccgccatgacaaccgccagctgcgaacgcatcgcacgggtgtaaatcacggttgcgactgcattggctgtatcatggaaaccgttaatcgcttcgtagaacagcacaaaagccagagcaagcaataataaaagcccggtatgtaaatccaggccagcaaacaaatgtagcataggacgttacgccattttgaggacatgaacgcggcgcattatcagtgactttggcggcgcgggcaaagtgaaatatagactttttttgatgtacttcgtgctttgtttgatatcactaaagaattatcttatatatttcagataaataccattttcaggcgcttttcgcgctggtgcgaccactgaggaaactttacaattctcgcccgaatttgagagaggaaggcgacgtggaaaggtttgatgctgttattataggcgctggcgcagcgggcatgttttgcgccgcacaggcaggacaagcgggtagccgcgtgctgctcatcgataatggcaagaagccaggacgtaaaatcctcatgtccggcggtgggcgctgcaactttactaatctttatgttgagcctgctgcgtatttgagccagaacccccatttttgcaaatcagcattagcccgctatacccagtgggactttatcgatctggtcggcaggtatgggatagcctggcatgagaaaacgctgggacagcttttttgcgatgattccgcccaacgcattgtcgatatgctggttgccgagtgcgacaaaggtggcgtaacgatgcgcctgcgtagcgaggtattgagcgtcgagcgtgatgagtcgggtttcgtactggcgttgaacggcgagacggtgactacgcaaaagctggtgattgccagcggcggcctgtcgatgccggggcttggcgcatcgccgtttggctataaaatcgccgaacagtttggtctcaaggtgttgccgacgcgcgccgggctggtgccctttacgctacataagccgctgttagaacagctccagacgctgtctggcgtctctgtgccctgcgtgattaccgcccgcaatggcacggtatttcgggaaaacctactttttacccatcgtgggctgtccggccccgccgttttacagatttccagctactggcaaccgggcgagttagtgagcattaacttattgccggatctctcgctggaagacgttctcaatgaacagcgtaacgcgcacccgaaccagagtctgaagaacacgctggcgatgcatctgccgaaacggctggtggagtgtttacaacagttggggctcatcccggatgtatcgctcaggcagttgaacgttcgtgaccagcagacgttggttgacacgctgacggcctggcaagtacagcctaacggtaccgaaggctatcggacagcggaagtgacgctgggcggcgtggatacaaacgaactatcatcgcggactatggaggcgcgccgcgtgccgggtctctattttatcggcgaagtgatggacgtcaccggctggttgggcggctataacttccagtgggcctggtcgagcgcctgggcctgcgcgcaggatttgattgcgttaaaaattaactaattgatattatgtgtttttcggtctcatttgactgatcgccgtatatcttggcctatagcatcttttagtcagaagtattctggataaggggcactcattttgcatggcatgaccaccgatttcgttttaacaatggggaatgcggacggtagttttcgctataaggtcgtggcagtaaaaccagataaattggtttcagctcgggagcctgaataactttagattgaacatctgttctggatgttactttgggttgatttcccgatttgcgttgactcaaaacagaatcaagtttagagataaaaatgtgttagacgatatctataatcagaatgaaacatgtttaaccattttcattatgaatgcattaatctcagctgggttttgaagcagaccgcattcaggtcggatactggccaacaacaccagatacagaataaggcccctgacagggccttctggtagtatgtagtcgatatttacactgtttacaacggggagtcatactttcttattaatcctgtaaagcaaaccactgcacagtgcgccagcaaaaagaacaactgcaatagtggcaaacatcagcgtatatgcaaattctttatacgtatcaagaaggtatccgaagataagatggacataagcttccgggctgaatccgatgcagattaatatccccattgcggtcccggtaaacactttcggtatgcgaatttcatttacctgcgcatacattataccgcgcatgccaaacgtaagcgctcccagtaataaaaccagagtaataagcaggatcagaaatcgtgagtcatgaggaataaatataaaagatgcagttatcaatgcaccgagaataaagaagctggccataactttcagggaagaaccaatcttatctgcaagtaggccagcaaaaggcgaaataataaaagcgagaaaatatgccctaatcatcccgataacggcagtttggtcgggagtcattccataggcatcggagaggtatggtaccagataagctccgccctggtaaacaaaaataacacagctgataatgaatgctgccagccaaagttttacacttttgagtagtgaaataagatccgacatttttttaggtgccgcattttcaatagcactaacacctttcggaaataaataataagaggtgaatcccagaataatataaatggctgcgtcaaatcgtaaaataaaaccaatgctgacagcactggagccatgcagaccaacaatagccacggcacataacgtcagaacagtgccggcaattccacgaccggactccagaaatccaaaataccgcccctgctcattgtctgatgcaaggagtctggcaatttttgtcatggaaaccaggaacagtccattaccgactaaggacataaatccgacgataataaacatggcctgataggaaggccggaaggactgccagatggcaagggccgccattgtgagataggcaatggtaagaatgcttttaggatttttgaaacggtcaacgatgatgcctgaaacagcacctgatataatgcctacaaacccgagccagctcattaacatgcccgattgtgtatttgtcagtgaaaagtattcattccacggatagtagaatacttcacgcaaatacatagccttgaatattgttcccccaccgactgccagaagaataaaaaaatcaggttatgccttttaatcgatttgtcttctgcatgttccatatgtccgcctgtataactagacgttattgtagattgatccgttagtgtcttgtgttattttaatttttgtatgtatttataaacagtgggttcagatatgttaagttttttggctactttcgttactgcccctttaagcagaaatacgccttcatcatttagtaatgaaataatatggcttttattttcagcattcagtgactctggattaatattttcaatattgattacattattaattttgagatcaaccatttcaggaatggtcagtccaatatgttcatcaagctgagtgccgttattattgtcagtctgcccgacaaaaatgcttaaaaaatgactaagtttatcattcagggcaattaaatcttcgacgacggtattcagacatagtgcaccaacaatttctccctgcttattccggataaaaaaagtggcacacttaagccgtctgccatcgcgtgtcttgctgagataattacactggtaatgtacctcactgtcattgttcttcatggcacggactaccagatcggtgatgggatctccgacagagcgaccgctgatatgtccatttctgattttatgtatagaagactcaagatcagaaagattgtgcagaacaacttccgtgttttcgccaaaataatcggccaggaaatcgatcaaaaattcatagggttcaagacaagtgtttttcatggttaatctggttgccacctcagtggcaaccacctttgttattgacgaaatgccacagcttcaatctcaactctggcacccataggaagtgtttttacagcaaaacagctgcgtgccggcggatttatcttaaaaaagctggcatagacatcgttgaacgcagcaaaatcagccatatcactcaagaaacaggtcgttttcagtaccgtatcagtatcaccgcctgccatcttaactacagccagaagattaagcagtgactgacgggtctgttcctgaatatcatcagtttcaattttgccactgtcagcgttaatgggcaattgtccggaggtaaaaattaaattacccatcgcattgccctgactgtatgagccaattgctgccggtgctgtttctgtaaaaataatctctttcacttctgttccttaaaaatacttactgaatgccttttccagacgactcagtgcttcatcaatacgtgactccggaacaccacagttaattcgggcaaatccggtaccggcaacaccaaactgatctccccggttaaatccgagtcccgcatcctgcactaaaaattcctgaatgcgatcacctgaccagcccgtatcattaaagtcggcccatacaagataagtggcttccggcagattggcttttaccggatatggcatgttattgagcccgttaaccagtttaatctgcattttacggatatgattcaccacctcttcacgatagtcatggtaatatttatatccggcataggcggcttcatgcgcgaacgcagtgggctgaaaatgtaattctttcaggacaactgccatctgttttttaaatacaggatcggccgtgaagacataggaactaaaaataccgccaatgttaaacagcttccctccggataaaaaaacgataatgccatttaaattttccgcagctttcatgaccggcgtatagcatttttcgtcatagacaaaatctgcatgaatttcgtcagaaatcaggattgttcctgttttctgggcaattgcggcgactttcctgacttcctcttcagtccagcaacgacctaccggattatgagggttacagaaaatcagaatcttattctccgggcgtgaacaggtatcttccagcttttcaaaatcaatagtgtaatgattgttttcatcacgcagcagatcacactcagttacagcacggtggttttcacggatggttctggcaaaagaatgatagaccggtgtcataaccacaacggattcattacactgtgtcattcccctgataaaagcgcccatcgtcatcagtaaaggcggtgtttcaataatatcagccgtatccggccgccagtcataatatcgatcataccaggatgccagcacatccttaaaatcatcatgataggccggatatccgaattctctgcggttacagacttcaatcagtgcctgacgaacctccacgggagaaactaaatcggtatctgcaacagacataggtattactggaaatccattaatgacactgtcatattcccatttttctgatgctattctctgatagatttcattaaaatcgtatttcattttattttccttaatttattcagccgcagtccggaaagtatctgccggtttaccatccattttcttaaatgccgttttggcattgcggagaagtaaaagtgaagtgaatacagcgagagcaaacatggcacccatgaagataaacatgtaggtgtaaccctgtactttatatgcatcaagccagtacccgaataacgcatggataaacatttccggagagaatcccacagtggccatgatccccataacggtaccggtcagacgaacaggaaccttcatttcctcaatttgcgcatacatgatcccgcgcagagcaaagttaatggagcctacaatcatcagggtgccgatcaggacccataccatagccggatcctgtgggatcaccaggaacatggcgacaccaatcaccccggcaataaacagccaattcatcaccttaatcgctgagccgactttgtctgcgagcagacccacaaccggtgcaatcaggatagcgaggacataagcacggatcataccgataattccggcatgttcggcggtcattccgtagacatcagacagataaggaaccagatatgaggacccctgatagaaggagatggttgcaaagatggagaaagctgcaaaccagacttccttaaccttcatgacagccagaatatcgtgtacagatattttttccttggccttttcttctccggaagcagaattatggttatcacggggcatggcgaaccacatcagaacacccagcgctaggtagagaaagccgtatgcatgtagcacactgccaatcccttccacttcggttgcagacatggcgaaccatgctacggcaacggcagagatggctgacccagcgataccacgtccggactccaggaaaccaaacagcttcccctggtcactggcattaccaatcaggcgggttgcgcgcaccatcgatactaggaaaagaccatttgcgaggaaagatagtatgccgatgatgacatactgcgtagccagacccggtgctgttgactgccataatgtggttacgcccacagccagaaaggtaaaagaaataatcagtcgggtattgttcaccttatcgataatcaccccagcaattgaagatgaaacaatccccacaaaccccagccaactcatcagcaggcctgaatccgtgttattcactcccatgaattcattccaggggtaataaaatacttccctgaggtacatcgatttaaaaatggtccctcctccgattgccagaagaatgaccatcaaccatttttgaaaattggatgttttcataaaccttcgcctgtccataaataagaaacaagtgttcatgtgagaatataattttttatacacatgaatattatgaagcacttcacagagtgggcaaaaaagataaaaaattatctcttctaatttaatatcattaaaatcatgtagttatatgtataataaattatacatatgtgtggggcattaattatttacggttgtaattttataaaaattataaatttttatatttcaggacgtaactgtctgacaacatatatgctgaatagggcggagaataggggcaggaaagtggataaaatattatcgtgttttacctccggcaggagcgtttccttattagaagtacgaatatttgatgccgtgggctgtatccatgttttttagccgggcccggcgacttgagcaggggtaatcacgcatgctttcgttaccagccccttcggtaaatagattgacgggcacgattttttgtctgcaacatctgtgctacaaccgaatagacatattgaatccaggtgttagtattcaatagacagcagttatgagtatgcgtgtttcatttccggccaggaacgctgatgatgacaacattactacccggtttcacagcattttcgtcattcacttccttcgcggcgcgcgttgccttaacgctcgctcaatggccattgtttttcattccttcttatcccggatggaaacccccgctgagcgcacgcccggcggactttgtgacacgcatggttaggcaacagggattacggcgggtcgattatggacaaaatgaagcgtcatctggtgtggtggggagcggggattcttgtggcggtggccgcgatcgcctggtggatgctgcgccctgcgggaataccggaggggtttgccgccagcaatggcagaattgaagccaccgaagtggatattgccactaagattgccgggcgtattgataccatcctcgtttcggaagggcagttcgttcgtcagggcgaggtgctggcgaaaatggatacccgcgtattgcaggagcagcggctggaggcgattgcgcagattaaagaggccgagagcgcagttgccgccgcccgtgccttgctggagcaacgccagagtgaaatgcgcgccgcgcagtcggtcgtcaaacagcgggaagctgagctggactccgtctctaaacgtcacgtgcgttctcgttcgctgtcgcagcgtggcgcggtatctgtacaacagttagatgacgatcgcgcggcggcggaaagcgcgcgcgccgccctggagaccgccaaagcgcaggtatctgcggcaaaagcggcgattgaggcggcgcgtaccagtattatccaggcgcaaacgcgcgtggaagcggcgcaggcgaccgagcggcgtattgtcgccgacatcgacgacagcgaattaaaagcgccgcgcgatggacgtgtgcagtaccgcgttgcggagccgggcgaagtgttatcggctggcggccgggtgttgaacatggtcgatctcagcgatgtttatatgacatttttcctgccgaccgaacaggcggggttgttgaagatcggcggcgacgcgcgactggtgctggacgccgcgccggatctgcgtattccggcgaccatcagttttgtcgccagcgtggcgcagttcacacccaaaaccgtggaaacccacgatgaacggctgaagctgatgttccgcgtcaaagcgcgtattccgccagagctgctgcgacagcatctggaatatgtcaaaaccggtttgccgggaatggcctgggttcgtctggatgagcgcgtgccctggcctgacgatctgaacgtgaggttgtcgcaatgacgtcgctgacgctggtgcctgttcctcccgtggcgcagcttgagggggtgagccagcattacggaaaaacggtcgcgctgaacaatatcacgctggacattcccgcccgtagtatggtcgggctgattggtccggacggggtgggtaagtcgagcctgctgtcgctgatttctggcgcgcgggtgattgagcaagggaacgttatcgtcctgggcggcgatatgcgcgatgcgaaacatcgccgcgacgtctgtccgcgcatcgcctggatgccgcaggggctggggaaaaacctttatcacacgctatcggtttatgagaacgtcgattttttcgctcgtctctttggtcatgacaaagctgaacgcgaagcgcgtattaccgagctgctgaacagcaccggcctggcgccgtttcgtgatcgtcctgccgggaagctgtccggtgggatgaaacaaaagctggggctgtgctgtgcgctgattcatgacccggaattactgattcttgatgagcctaccaccggcgtggactcgctctcccgcgctcagttctgggacttaatcgacagtatccgccaacggcagaccaatatgagcgtgttggtcgcaacggcctatatggaagaggcggagcgttttgactggctggtggcgatgaatgcgggcgagatactggcaaccggcagcgcgcagcaactgcgggcaaaaacccatagcgcgacgctggagcaggcgtttatcgccctgttgccagaagcgcagcgccaggcgcataagccagtggtgatcccgccgtatcacgctgagcaggaagagattgccattgaggcgaaagatctgaccatgcgcttcggtaagttcgtcgcggttgaccatgttaatttccgcattccgcgcggcgagatttttggcttcctcggttcaaacggctgcggcaaatcgaccaccatgaaaatgctgaccggtctgcttcccgccagcgaaggccaagcctggctatttggccagccggtagacccgaacgacatcgatacccgtcgccgggtcgggtatatgtcgcaggctttttcgctctataacgaactcaccgtgcggcagaatctggaacttcatgcccgcctgtttcatattccgccagcggagatcccggcgcgcgttgcgcagatgatcgaacgctttatgctaacggaggtggaagatacgctccccgcttcgttgccgctcggtatccgccagcgtttatcgttggcggtagcggtgatccatcgcccggaaatgctgattcttgatgagccaacgtccggcgttgatccggtcgccagggatatgttctggcagcttatggtcgatctttcgcgtcaggataaagtgacgatttttatctcgacccattttatgaacgaagcggaacgttgcgaccgaatgtcattgatgcacgccggtaaagtgctcgccagcggtacgccgcaggaattggtgcaacagcggggcgcggccaatctggaagcggcgtttatttcctggctacaggaagctgcgggagcggcgcctgaaaccccaataccgccatcccagacgcccgccgcgtcagataaaccgtcgcggcagggattgagcttccggcgtttgttcagctacagtcgccgcgaagcgctggagctacgccgcgatccggtacgctcgacgctggcgctgctgggaacggtaattctgatgctgattatgggctatggcatcagtatggacgtggagaacctgcgttttgccgtactcgaccgcgatcaaaccgtcagcagccaggcatggtcgctcaatctggcgggatcgcgctattttatcgaacagccgccgctcgccagctatgacgagcttgaccggcggatgcgttcgggagagttggcggttgccattgagatcccgcctaattttggccgcgatattgctcgcggtacgccagcgcagattggcgtctgggtggatggcgccatgcccagccgcgccgagacggtgaaggggtacgttcaggcgatgcaccaaagctggctgcaggaggcggcaagtcgtcagccgaacccggttaaacaaaccgggctgctcaacattgaaacgcgctatcgctataacccggatgtgaaaagtctgcccgctatcgttccggcggtcattccgctgctgctcatgatgatcccgtcaatgcttagcgccctgagcgtggtgcgggagaaagagctggggccgatgattaatctgtacgtaacgccgacgacgcgcagtgaatttttgctgggtaaacaactgccgtatatcgcgctgggtatgctgaacttcttgctactgtgcgcgctgtcggtctttgtgttcggcgtgccgctgaaaggcagctttctcacgcttaccctcgcggcgctgctttacgtcatcatcgccaccggtctggggctgctgatctccacgtttatgaagagccaaatcgccgctatttttgggacgtcgattattaccctcattccggcaacacaattttccggcatgatcgatccggtggcttcgctggaaggaccgggaagatggatcggcgagatctacccgaccagccattttctgacgatcgcgcgcgggacgttttccaaagcgttggatctgtccgatctctggtcgttatttatgccgttactgattgccgtcccggtggtgatgggtctgagcattctgctgctgaaaaaacaggaggggtaatgcgcggattacgtaatatttataacctcggcgtcaaagaactgcgcagtctgctgggcgacaaagcgatgctggcgctgatcgtcttcgcctttacgatttcggtttactcctccgcgaccgtcctgcccggttcgttgcatcttgcccctatcgccatcgccgatatggatcagtcacagttgtcgaaccgtattgtgaatagtttttaccgcccgtggtttctgccgccggagatgattacggcaacggaaatggatgccggactggatgccggacgctatacctttgcggtcaatattccgccgaatttccagcgtgatgtgctggccggacgtcagcctgatatccaggttaacgtcgatgcgacgcgcatgagccaggcgtttaccggcaacagttatatccagaatattattagcggcgaggtcaacagctttgtggcgcgcgcggggagatagcgttcagccggtgtcgctggaaattcggatgcgctttaacccgaatctggacccggcgtggtttggcggcgtgatggcgattatcaacaacattaccatgctggcgatagtgctgaccggatcggcgctgatccgcgagcgagaacatggcacggtagagcatctgttagtgatgccggtcacgccctttgagatcatgatggcaaaagtgtggtcgatggggctggtcgtgctggtggtttccggtttgtctttgatgctgatggtgaaaggcgtacttggcgtaccgattgaaggatcgatcccattgtttatgttgggcgtggcgctgagcctgttcgccaccacttcaattgggatttttatgggcaccatcgcccgttcgatgccgcagctggggttattaatgattctggtgctgttgccgctacaaatgctctccggcggttccacgccgcgcgaaagtatgccgcaggcggtgcaggatattatgctgaccatgccaacgacgcattttgtcagccttgcccaggctattctttatcgcggcgcaggtttaagtattgtctggccgcagttcctgaccctgctggcgataggcggcgtgttcttcctgatagcgctgttacgcttcagaaaaacgattggcacgatggcgcaaacattattgccggatggcggctgcgcctcatccggcctacaaacgacgacgtgcgaacgtaggccgggcaagcgaagcgcccccggcaaggcgctggggcgttagtcttctttcggcaaacattgcaagtggccgtggcgcacgccgcgctgggcgataacatcatcggcaaaatgctgtacgtcgcccatatcgcccttcagaacggcgatctccagacagtcatcgtggttgatatggacgtgcagcgtggcgacggataaatcatgatgatgatgctgggtggagacgatgcggctggctaaatcccgtttctcatgttcataaacatatgaaagtaccgcgaaaccctgtgtaccgtgttcctgggtggcctcctgcgccagagcgccgcgcagaatatcacggatcgcttcggagcgattgttatagccgcgtcgctggctcaggctgtccagcgtttccagtaaatcgtcatcgagggtgatggtgacacgttgcatctgacttaaaccttttggtatggcgcgtcggcgcatgggaagctccgcattttgtaacacacgtccgccgccagagggaaaattaatgtgtcataacgcttttgttatcgtctgcggcgtcagcgtaaacggtgtgggggtacagactgccagactgagcgtatcgagctgacactggctgaccgacaaggcagagggcaacgtgctgtccacgctgacgatttgccaggcgctgccgccgcgttgttttacgatggcttctttacgcgtccagatacgccagaaggccgccagttgtcgctccggacgttccgcttccatttcagcatgttcgccgaggctgaataccgcatttgccagcgaacgccagttatcgcgcgggcggatcacttcaatatcgcagccgacttcaccttcgtcgctaagcaacagagcaatagtgtcgccgctatggctgaggttaaaccacagcggcgttccggcggaaaaagccggtttaccctgttcgccatacaccatctccggtagcggcgagagcgcacgggaaagcagcacgcgcccggccagccagcttgcccggcgaacgccctgcggcgcctgagcgattaacgcgtcgggcaattgacctgcgcttaatgttgacacttttcccagaacgatctggtacatatcaggaccaacgttgcctatgaagaagaggagattgtagcatctgtcgcctcatcccggtaaacggcttttcggtcggcctggccccagtaagatcgccagtttgctgccgcctttagtggtttccatccagattttgcagacgctggtcaaaggaacggacaagagcatcccgaccgggcctaatagccatccccagaccagtaacgaaagaaataccaccagcgtggacatccccagacgatggcccatcatgcgtggctccataatgttgccaatcaccatatgaaccaccaaaaagagcgcgccgaccagtacgcattcgtaaaagccgttaaataacaacgcctgaatcatggggggaacggcggaaatcaccgagccgatattaggaacgtaattgagcaaaaaggccagtacgccccacattagcgcaaactgaatatccattaatgccagccccagccagataatcgcgcccgtccatagactgagcagcgttttcagcgccagataatgcgagacgcctttcagggcgcggtgcaggccggcaatatggatttgtggattgttaagcgcgaaacgtaatttataaggcacgtgacgcacctcaaacagcataaaaaccacggtcatcaccagcagcacaatgcttgccatcgcgcccgatacgccggtcattaatgttgtggtgaagagcatgattttatcggaatccatcccacggagcatacgttccggcgacatatgtaaattcaggaagggcattaactcctgaagatgtaaaaccttacgcgtcagctccttgctgtatttaggcagcatagcgataaattcattaagcgatgcggcaagcacacccaccagcgcggtaagcacgatcagcatgacgaccaccacgatagtaatcgccagcggtcgcttcacgccccggcgaataaaccaggtcactaatggattaagaacgatggcgaaaaagagcgccagtaagagttgtacaataatatccgccgcggcatgaatcccggcgagaataataaccagggaggccagtttcagcagaatatgcatacccgttttgtcgggttgagcggttgccatgaagttttccttgttgtgtttttttctaagtgtagcggctgccctgataccgataatctgaatctcactactgattttcaccgcgcgccatgatagaaaagaaaacatgttgtaaaaatgcggtgatactcatgcccgaacccgtcgctgaaccggcgctaaacggattgcgcctcaatctgcgtattgtctccatcgtgatgtttaactttgccagctacctgactatcggcctgccgctcgccgtcttgcccggctatgtgcatgatgcgatgggattcagcgcgttctgggcggggcttattatcagcctgcaatacttcgccactctgttaagccgtccccatgccgggcggtatgcggatgtattagggccgaaaaaaatcgttgtctttggcttatgcggctgttttttaagcggactcggctacctgctggcggatatcgccagcgcctggccgatgatcaatttgttgctactggggctgggtcgcgtgattttggggattgggcaaagttttgccggcaccggttcgacactgtggggcgtcggcgtcgtcgggtcgttgcatattggtcgggttatctcctggaacggtatcgtcacctacggcgcaatggcgatgggcgcgccgctgggcgtgctgtgttatgcctggggcgggttacagggactggcgctaacggtgatgggcgtggcgctgttggcggtactgttagcccttccacgtccgtcggtgaaggcgaacaaaggcaagccgctgccgtttcgcgcggtgctggggcgtgtctggctgtatggtatggcgttggcgctggcctcggcagggtttggcgtcatcgcgacgtttattaccttattttatgatgctaaaggttgggatggcgccgcctttgcgctcacgttatttagcgtcgcgtttgtcggcacgcgtttgctgttccctaacggtatcaatcgcttaggcgggttgaatgtcgccatgatctgctttggcgtggagattattggtctgttactggtggggacggcagccatgccgtggatggcaaaaatcggcgttttactcacggggatggggttttcgctggtctttccggcgctgggtgtggtggccgtcaaagccgtgccgccgcagaaccagggcgcggcgctggcgacctataccgtctttatggatatgtctttgggggtgaccgggccgctggcggggctggtgatgacctgggcgggcgtgccggtgatttatctggcggcggccgggctggtagcgatggcgctattactgacctggcgcttaaaaaaacggcctccgtctgcactgccggaggccgcatcatcgtcgtgaaggttacttaataaccaacgtattgatgatgttttcagctgtggtttgcgctttttgctgattgtccgcaggcagcgtgacctgaatcgtcagcaattggttatccactttgcccagcacgatggaagagtacgccgtctggcctttcgcggagataatgctgtccagctgttgcaacgtatggcctttgagctcaatagacttattggtgacgacctgaagctgcgggtcgcggctacgctgttgctcaagcaggcggttcgccagcaccggcaacgcttcatcggtattatcgccgacgataacaatcaccgctttctggcccgtcgggtcagaataaacgtgcatattattcgcctgggtgcccagcttaccgctttgatcggtcatatccgccggcagtgagaaactgagtttgccatccatcaggctgatgggctgaccggaggcctggctttctgcggcggcgctttctgccgacgcttttgtatcgttgttatcacaggccgcaagccccataaccagcaggccaataccggcatatttaaccaaattgcgcattgacttcttcctttcgataaacggccataacggctcattcgctcatcttatcacaactcggaaaacgaacctttaacttgccggtaatggggaaatttcagatttatctgccagctttttcagcaacatattcagtagaacgccgtacatcggcaggaagaaaataatgctgatgagcaccttaaagcaataatccaccagcgcaatttccatccagtgcccggccataaaggcatcggggcttcgccagaacgcaatgaagaaaaaggcaagggtatcgctgatattgccaaacagcgttgaagcggtcggcgccagccaccagcgacgattttggcgcaggcggttaaacacatggacatcaaggatctgtcccagcgcgtaggccataaagctggcggcggcgatacgggcgacgaacagattaaagttcgccaacgcggcgaaaccttgccaggcacccatatagaacagcgatgacaccacatatgacaccagcagcgcagggatcatgacggcgaagataatgcggcgcgccagcggtgcgccaaaaatacgcacggtaagatcggtggcgagaaaaataaaaggaaaactaaacgcgccccaggtcgtgtggaaaccaaaaatagtgatggggagctgcaccagatagttactggaaatgatcaccagtaaatggaatagcgatagccagaacaacgcttttatgcgctgtgattgtgtaaacggagtcatattgtgacctttttgttggatggggtgagggaacccaataaagaaccgccgcataatactgttttgcgctggcattgcaatggctaattttcacgcaatcgttaacctgcttggcttactgacgaagatgggcgtaaaatatcgccgtttttctaccattgagacgaagatgagcgatctgttttcctcccctgaccatacgcttgacgccctggggctgcgttgccctgaaccggtaatgatggtgcgcaaaacggtgcgcaacatgcaaactggcgaaacattgctgattatcgccgacgatccggcgacgacgcgtgatattccggggttctgtacctttatggaacacgatttgctggcgcaagagacggagggtctgccgtaccgctatttattgcgtaaagcgcattaaccgcacggcagatagcattctgattagaagctttcccagttcgcctgttctgcggcgggctgtggcgttaagcctttgcttaacggcgtcggcgacgcctcccgacgaggttgtttctggatgcggaacgcggcgaccgcctgacgaagctcgttagcctgatcttccagcgccgccgctgctgctgcggattcctctaccagcgaggcgttttgctgcgtcacgctgtccatttccgataccgcctgcgccacctgctcaatgcctttgctttgctcatcggaggcagaggcgatttcgcccataatatcggtcacgcgggtcacggcgttaacgatctctttcatggtttctcccgcttcgcgtacctgcgtagagccggtatcaatgcgcgacacggagttttcaatcagcactttgatctctttggcggcctgcgcgctacggctggccaacgtgcgtacctctccggccacaaccgcgaatcctcgcccctgttcgccggcgcgggcggcttctaccgcagcgttcagcgccaggatattagtctggaaggcgataccgtcaatcacgctggtgatgtccacgattttttccgagctttcggcgatatcgttcatggtgctcactacgttatccaccacgcgtcctcctttacgcgcggtttctgatgcggttttcgccagacccgtcgcctgtcgtgcgttatcggtgttttgccgtaccgtggcggttaactgttccatgctggcggcggtctcctccagcgccgaggcctgctgttcggtacgggaagagaggtcgctgctgccagcggaaatttcgcctgcgccagtatagatagagtctgcgttatcgcgcaccgcgctgacggtacggattaacgactgctgcatcgttttgagaccggcagccagttggcccatttcactacgtccttcagcctctatctcatgggtaagatcgccgtcggcgatcgtttgaatgtgcgccataatccgttgcagcgggcggagtagaacgcgttgcagccccagccagataaacgccagcacgatgagcacgataagtagaattatccccagcgtccattgcatctgggtaaaactgctctgattctgatcgctggctaattttattaattgcgcattttgagagagccactggtcatatacctgctccatgtcatcctgcgctttttgcgcgtcaaggttgccataggcggcgtaattatcggctttaagatagtggatagactgctgcaaaacgtcatacatctgcttaaagctggcttcggcctgggcatccaacgccggatctttgcctgcgatcgcttcggagttcacgtagttgttgaaatgcttttccgcttcgttgagcgacgcgccagcgttggttaacagcgtgttcatggcgtccagcgaggcgggatcgcgctgattttttaacatgcgtatcgccacgcggttaatggtgacgcgggtttcaatcaatgtctgaaaactgccgcccagttcctgttgttggtaactcagtgcgctcgcattctggaaattcagccgatcgctgctgacggcggaataaaacagtattcctgtcaccaacaataaggcgctaaatatgcccagcgtcgcgataacgccggtgatgactttgatatttttcatagtgcctaacattccttattttgtagacggtatgatcaatatcggttggataaaaattaaccttacatcaaatcgcgctatttctgattaatggtttgataagtaatagaaaataaatgattttcgcgtgaataatatgtacaaagaaaggaatatcgcgggataacccggcgacatgccgccgggtgggagaagattagtttttacgcagcaaacgtagcgcgttggcggtcactaataccgtggctcccgtatccgccaggattgccagccatagcccggtaaaacccagtagcgtcgtcaccaggaaaatggctttcagccccagcgcaatggtgatgttctgccggatattcgcgtgggtagcgcgcgccagcgtaatcatctgcgctaacccgcgcagacggttatgagtaagggcggcgtcagccgtttccagcgcgacgtcagtaccgctgcccatcgcaattccgatactggcggctttcatcgcgggcgcatcattaatgccgtcgcccaccatcgccagcggcgcttgttggttaagggcggtgactgcccgcaccttatcttccggcagtagtccggttttaaacgccagatccagctcgccggcaatcgctgccgccgcccgtgggttatcgccggtcagaatcacgccgttaacgcctaactgatgcagttcgcggatggcgtcgcgcgcatcgtcacgcaacgtatcctggagggcgaggacgccaacaacggtctcgttacgtagcaccagaaccaccgtctgcccggcgttttccagttcgctaatttgcccggcaaacgctgccgcaggctgttttcccgccgcgcaaatcagaatacgttcgccgttaacctgcgcttcaatcccggtgccggccagcgttcgctgcgattccgccgtcgggatcgccagatcgcgtgtctgcgcttcgcggacaatagcctgcgccagcgggtgcgtagcgccttgttctacggctgccgccagcgccaacagttcagcctcgctgataccgcttgccggatgaatcgccgtcacccgtggtttaccgatggtcaacgtaccggttttatcaaaggcaacctgcgtgatacggcccagttgctccagcgctgctccgcctttaatcaatgcgccgcgccgtgccgccgccgccagcccggaggtaatggccgcgggcgtggagatcaccagcgcgcacgggcaaccgattaatagcagcgtcagccctttataaatccactcctgccagccgccatcgaacatcagcggcggaataagcgtcaccagcagcgcgatgaccataatgactggcgtatagatgcggctgaaacggtcaataaaccgctcaatgggcgcacggcgctcttccgcctcttcaatcagcgtcaggatacggtcaatcgcgctggcgccaggttcagatagcacctccagggtgacgagacggtcaacgctggtcgcgcctgccgggactttgtcgcccgttgcgcgctccacagggatagactcgccggtgagcgcgctttcatcaaagctggcgaaaccggaaaccagtttaccgtcggcgggtaaacgccccccggcggcgacttcgataatatcgcccggtcgcagggtattaatagcgacctcttcccgcacgccgtcgcgcagacgggtcgccgtttccggtttaagcgccattaacgcgctgacgcctttacgggcgcggctggcggcccatccttccaggcgctcgccgatgaggaacagcagcaataccattgctgcctccgccgtcgcgcctataaacagcgcgccaatggcggcgacgctcatcagcgtttcaatagcgaaccaactgccgcttttcatcagccgcagcgcctggcgggcaataggatacagaccgaccagagtggtgacgataaaggccagttggccgaacgggtggttaaattgctccagcccccagcttatcgccatcataatgatcagcgtaataagcggcaggttctctttaagacgagattcaggcgcggcgtcgcgcgaatcttcactacgcaaggtataacccgccttctgtacggcgtgttcaatttgcgcgcggaggtcggtgtcggcatcgaccactaacttttcggtggcgaacagcacttgcgcctggttgacgccgcgaatttggcgtaccgcattctccacttttcgggcgcaggcggcgcagtccatgccggagattttccaggtatagcgcgtgcctgccacggcagtagaaacaggcgcgctggacgcgcaatgttcttcgcagcagcagctatcggccttctgtattgccggggctaatctgaaggaggtaaagggcgggacttttttgccatcggtatcaggggtcgacataacgtcctccggttgatgataattttctcattaaccggaggatacactctggagtcgactccagagtcaagcgctattatttacaggtacagcgagcgaacaatcaggaagtgtcctgcaaagtagcaggcggcggcaatcgcgttatccgcccggaaacggcggcggtaatggctacccagccagacgatattgccgatgaacagcagcgtcgcgccggtaaaggccgaaagggctggcgccgttgggcggaagaaccacagttcgcccgccagccagaccatgaccagcgtcatggcgataaaagtacataccggccagcgtagctcctccagtcgcgtccagataacggcgataagcaacgcgccgactatcagtaacgccagcggcagcggccagaagaacgacaacgtcatttggctggcaaagtaaatggtgtagagcagatgcgataagaaaaatgccccgacggcgtacagcaggcgttgacgcggtaagagcgttaacgcatcgccgaccagcgaggcgcacagtccggccaacacaagataactgatggcgtcaaacatcggcgcttgccaggccagtaacagcaacagtaataacgtgacgggcttaaaaacccagcgttgccaggctggcccgcgataggaggcgtccacatacagccatgcggacaggcagacagcgataaacgaccaaagcatcttaattccttgaattcgttattttttcgcaaacggtatgcttgcggctctattattcagtgtagaggccgtgacggtcagatgacaacactataacgggcagggtatgcttatttccgcattttctgacaggttaacagtatgagtaagccaccgcttttcttcattataatcattgcattaatcgtagttgccgcgtcgttccgcttcgttcagcaacggcgggaaaaagccgctaatgaggcggcgccgttacagcaaaagcaggtcgtggtcagcaataaacgggagaagccggttaacgaccgacgctctcgccagcaggaagtgagcccggcgggaaccagtatgcgctatgaggccagttttaagccgctcaatggcggtctggaaaaaacgttccgtttacaagcgcagcagtaccacgctttgacggtgggcgatcaaggtacgctaagctataagggaacgcggttcgtcggatttgttagccgtaccccggataacgaataaaccgtcatccggcagcaaacgttattttttgttcttaaacttcttctgccagaccagcagctcaaacacgctgaacaggaaaatgcggattttctctcccgtcgtcatctgcggacccgctttcggtatcgttgatttcagcaacgccaactgcataccgtgcatcagcgccatgaacaccaacgccacgttgacgaagatattgagcgggcgcgggaagggatgcaccagattaagaatcaaaaatgcccacacgaagagcattaataagcggcccagattaatcaacatcattttctccttgcgcgtcgcgctgatacagacgataagcgacctgtccggccaccttttctcgatacaatgcccagttcgccggaacgggcggcagaccgttttccacctcgctttctacgtagattagcgcgtcgtcggccagccatccctgggtttctagcaattgtaacgtctcttccagcagtcctttacgaaacggcgggtcgacaaagacgacgtgatgcggcgtccccggctggctgaggaaggccagagtattggtattgacgacgcgagcattgttggctttcagcgtcgccagatttttttgcaactgctgcgatacggcgcgatccatttccagtaacgttgcctgggccgcataacgcgatagcgcttccagacccagcgcgccgctgccggcaaagcaatccagacaatgggcgtctaccattaccggagccagccagttaaataacgtttcgcgcacgcgatcggtggtaggacgcagacccgggctgtccggaaccggtaatttacggccacgccattgcccgccaataatgcggatttggccgctgccagagtgagtcggttttttcatttctcttgctcgaaccgcctgttgcaagttattccaggcggtgatgtgaattaagttaagtgatagactatttcatcatttttttagcttccatgtatatagcgccgcgaggggtgtagtcgcagatggcaaaacagaaaaaacgtggcttcttttcctggttgggcttcggtgataaagagcagaagcaggaacagaccgaagaacagcagattgttgaggaacaacgaccggttgagccccctgttgaaacggcggcagacgtagacgcgcaaacgcccgcgcacagcaaagcagaaacagaagcctttgcggaagaggtggtggacgttactgagaaagttcaggagagcgaaaaaccgcagccggtagagccggagcccacggcggccattgagatggcagcgccgcagatcgcggtggaacgcgaggaattgccgctgccggaagaggtcaaagacgaggctatctcgccggaagagtggcaggccgaagcggaaaccgtagaggtcattgccgcggtagaagaagagggcgaaaacgcggcgaaattcaccgacgaagagctggaagcgcaggcgctggccgctcaggcggcggaagaggcggtgatggttgttccgccggcggaagaagacgcgccggtggaagcgatcgttcaggagcaggaaaaaccgactaaagaaggtttctttgcccgcctgaaacgcagtctgctgaaaaccaaagaaaatctcggttccggatttatcagtctgttccgcggcaagaaaatcgacgatgatttgttcgaggagctggaagagcagttgctcatcgctgatgtcggggtggaaaccacgcgtaagattatcgctaatctgacggaaggcgccagccgcaaacagcttaaagatgccgaggcgctgtatggtctgttgaaagacgagatgggcgagattctggcgaaggtagacgaaccgcttaatattgaaggtaaaacgccttttgttattctgatggttggcgtgaacggcgtgggtaaaaccaccactatcggtaaactggcgcgccagtttgagcagcagggtaaatcagtgatgctggcggcgggggatactttccgcgcggcggcggtcgaacagctacaggtctggggacagcgtaacaacattccggttatcgcccagcataccggcgcggactccgcctcggtgatttttgacgctatccaggccgcgaaggcgcgtaatgtggatgtgttaattgccgatacggcagggcgtttgcagaacaagtcgcacctgatggaagagctgaaaaaaatcgttcgcgtcatgaaaaagctggacgaagaagcgccacatgaagttatgctgaccattgacgccagcaccggacagaacgcggtaagccaggccaaactgttccatgaagcggtgggcttaaccggtattaccctgaccaagctggacggtacggcgaaaggcggggtgattttctcggtagctgaccagtttggcattcctatccgttacattggcgtgggcgaacgtatcgaggatttgcgtccgtttaaggcggacgattttattgaggcactttttgcccgagaggattaacaatgattcgctttgaacatgtcagcaaggcctatctcggcgggagacaagcgctgcagggagtgacattccatatgcggccaggcgagatggcgtttctgaccggccactccggcgcggggaaaagtaccctgctgaagctaatctgtgggattgagcggcccagcgccggcaaaatcttcttcagcgggcatgatattacgcgcctgaaaaaccgcgaagtgccgtttttgcgccgccagattgggatgattttccaggatcaccatctgctgatggatcgcacggtctatgacaatgtggcgataccgttaatcattgccggcgccagcggcgatgatatccgtcgtcgtgtgtcggcggcgctggataaggttggactactggacaaagcgagaaacttcccgattcaactctccggaggcgaacaacagcgcgtgggcatcgcccgcgcggtggtcaataagccagcggtattgctggcggatgaaccgaccgggaacctggacgacgcgttgtcggaagggattttacgtctgtttgaagagtttaaccgcgtaggggtgacggtactgatggcgacgcacgatattggacttatctcgcgtcgttcctataggcagctcgtcctgagcgatggacatctgcatggaggcctggccaatgaataggcgcgacgcgattaaccaaatcaggcagttcggcggacggctggatcgactgcgtaagtctcgcggcggaacaggcggcgggcgcaacgcgccaggacgccagaagccgacgccgaaaccgaactcacgtaaaacaaatgtttttaatgaacaggtgcgctatgcttggcacggtgcgctgcaagatctgaaaagcaaaccgctggcgacgtttctgacggtgatggtgatcgccatctccctgacgctgcccagcgtctgttacatggtctataagaacgtcaaccaggcggcgactcagtactatccgtcgccgcagatcaccgtttatctgcaaaaaacgctggatgatgacgcggcggcgcgggtcgttgggcagcttcaggccgagcagggcgttgagaaggtcaactacctgtcccgtgaggacgcgctgggcgaattccgcaactggtcgggttttggcggcgcgctggacatgctggaagagaacccgctaccggcggtggcggtggtgatccccaagctggactttcaaagtaccgcctcgcttaatacgctgcgcgaccgtatctcgcagattaacggcattgacgaagtccgcatggatgatagctggtttgcgcgtctggcggcgctcaccgggctggtgggccgcgtgtcggcgatgattggcgtgctgatggtcgcggcggtcttcctcgttatcggcaacagcgtgcgcctgagcatttttgcccgtcgcgacaccattaacgtgcaaaagctgattggcgcgaccgatggctttatcctgcgtccgttcctctacggcggcgcattgctcggtttttccggcgcgtttctttcactgatattgtctgaaattttggtgatgcgtttatcatcggcggtgactgaagtggcgcaggtcttcggcacgaagtttgatctcaatggtttatcgttcgatgagtgcctgttgctgctgctggtctgttccatgatcggctggatcgccgcttggctggctacggtgcaacatttacgttactttactcccgattgataaaatcgtggtataatctttccctgcaatgggcttccgttcgcagggaaagagtccctgttgtctcttccccgcgtttcatcttcatgtcacattatgtgtgtaaattatgcacagtgttacattgaacttgtggataaaatcactgtctgataaaagagtggatgatattctcgttgctcatcggctttggcacggttgttgctcgctgacggtgccaggcaatactgattgagaggatttgaatgaccaaagaaatgcaaaatttagctttagcccctgttggcaacctggaatcttatatccgggcggcgaacgcgtggccgatgttatcggctgacgaggagcgggcattggctgaaaggctgcattaccagggcgatctggaagcagctaaaacgctgatcctgtctcacctgcgctttgttgttcatattgctcgtaactatgcgggctatggtctgccgcaggcggatttgatccaggaaggcaacatcggcctgatgaaagccgtacgtcgtttcaacccggaagtaggcgtgcgcctggtctccttcgccgtacactggattaaagcagaaattcacgaatacgtgctgcgtaactggcgtatcgttaaagtcgcaaccacgaaagcgcagcgtaagctgttctttaatctgcgtaaaaccaagcagcgtctgggctggtttaatcaggatgaggttgaaatggtggcgcgcgaactgggtgtttccagtaaagacgtgcgtgagatggagtcgcgtatggcggcgcaggacatgacgtttgacatgtcttcggacgatgagtccgacagccagccaatggcgccggtgctgtatctgcaggataaatcgtctaactttgccgacggcattgaagacgataactgggaagagcaggccgctaaccgactgaccgatgcgatgcaggggctcgacgagcgtagccaggatattatccgcgctcgctggctggacgaagacaataagtctacgttgcaggagctggccgatcgttacggcgtctccgctgagcgtgtgcgccagcttgaaaagaacgccatgaaaaagcttcgcgctgcgatcgaagcgtaatcttcgcgaattgccaatgaaccctcgaatgtgaattcgggggttttgttttttgtaggccggataaggcgtttacgctgctatccggcaacacgtttgcccgatgtcgcttcgcttatctggcctacgggcccttcctctcccccaccgacacaaatctgttatctggatgtaaatttagctattccaaaataataaaaatcgggtatgttttagcagagtatgctgctaaagcacgggtagctagccaataatcgaaataaagtgctgaacaataacaccacaacacacgtaacaaccagaataatggggattatcaggatgaatatgaagggtaaaacgttattggcaggatgtatcgccctgtcattaagccatatggcattcgcagaggacattaaagtcgcggttgtcggcgcgatgtccggtccggtggcgcagtatggcgaccaggaatttaccggtgcggagcaggcaattgccgatatcaatgcgaaaggcggtattaaaggcgataagctcgtcgcggtgaaatatgacgacgcctgtgatccaaaacaggcggtagcggtcgctaacaaagtggtgaacgacggcatcaagtatgttatcggtcacttatgctcctcttccacacagccagcgtctgatatctacgaagacgaaggcatcctgatgataaccccggcggcgaccgcaccggagctgaccgcgcgcggctataacctgattttgcgcacgaccggcctggactctgactagggaccaacggcggcaaagtatattctggagaaggtaaaaccgcagcgcatcgcgattatccacgataagcagcagtacggcgaagggctggcgcgcgcggtgcaggacggtctgaagaaaggcggcgttaacgtcgtattctttgacggcattaccgccggcgaaaaagatttctccactctggtagcgcgtctgaaaaaagagaatatcgactttgtctactacggcggttatcacccggaaatggggcagattttgcgccagtcccgcgccgcagggctgaaaacccagtttatggggccggaaggggtggcgaacgtctcgctgtctaacatcgccggagagtcggcggaaggcttactggtcaccaaaccgaagaactacgatcaggtcccggcgaacaaaccgattgtggatgccatcaaagccaagaaacaagatcctagcggcgcattcgtgtggaccacctacgccgcgctgcaatcgttgcaggcgggtctgaaccagtctgacgatccggcggaaattgccaaatacctgaaaggcaccacggtcgacaccgtaatgggaccgctgtcgtgggatgagaaaggcgatctgaaaggatttgagttcggcgtgtttgactggcatgcgaatggtgcggcgacagacgctaagtaattttcctggcgcctttcgcgctgcaggtgcgttggctacgttattcaaccccggtcacttacttatgtaagcttccggggatttcataacttgccgcctgcctgcaacgcgaaattcttggaaaattgcgaggtggtttttatcttttctcccggcatgtaggccggataagcgtcagcgccatccggctttcttttagcgcttctcccagccgtcatgctgggcggtaaaacctaacgcctgcataaacgcggccatcacgctgcggtcttcaacaccgacatccgccatccaccacgacgagacgttgggattatcgcggatgacctcttctaccaggtattgcccgacgccgcggcgacgggtgatttcacgcacgcgtaaggaatccagcgcgccctgcgttccgctcagcgtcactcttacggcgcccaacaaacgctcgttaaaccgcgcggcataaatccggtgcgtttcatctacgcttaatgaggaggcggaatattccggccagattttgcccagatcgatctgatcctgagcgctaaagtgttctaaacgaagaatggtcagcttcatcgacggcttgtcccgatttcaaaagatgcgatcagtgtaccgaaacaggcaggccagatgctttctcttttttgtgtcatttaccaggttattaattttttaacaacgataattacagtttgaagcattagagaatggaaaacaggcagcataattccctgaatgctagtgaattattccgcttaatgtgccgttattttatgctgacaagcgtgcttttttttgtttatctataacgaaaagcagaatattatattttcttaatagactgaaaaatagagattttaatcttattatgctttaaatgctgcgctaactcattaatgagtcagtaaaaagcgcaccatttataaaaagtacagtctgctttttaaccagtaaaaaacaaaacatataacatcacgaatggggatacaggcacatgaaacggaaagcgaaaacaataatcgcagggattgttgcattagcagtctcgcagggggcaatggcagatgatattaaagtcgccatagtcggggcgatgtccggcccggtagcgcaatggggcgatatggaatttaacggcgcgcgccaggccattaaagacatcaatgctaaaggcggtattaaaggcgataagctggtcggcgtagagtacgatgatgcctgcgatccaaaacaggcggtggcggtggccaacaaaatcgttaacgacggtattcagtacgttattggtcacttgtgttcttcttctactcagccagcatccgatatctatgaagatgaaggtattctgatgatctccccgggggcgactaacccggagctgacccagcgcggctatcagtacattatgcgtaccgccggcctggactcctcccaggggccaacggccgcgaaatacatcctggaaacggtgaaaccgcagcgcatcgctatcattcacgataaacagcaatacggcgaaggactggcgcgctccgtgcaggatggcctgaagcagggcaatgccaatattgtcttttttgatggtattaccgccggcgaaaaagatttctccgccctgattgctcgcttgcaaaaagagaatatcgactttgtgtattacggcggctactacccggaaatggggcagatgctgcgccaggcgcgggctaatggcctgaaaacgcaatttatggggccggaaggcgtgggtaacgcgtcgctgtccaatattgcgggcggtgcggcggaaggcatgttggtgacgatgccaaaacgttatgaccaggacccggcgaataaagcgattgtcgaggcgctgaaagccgacaagaaagatcccagcggtccgtatgtctggatcacctacgccgccgtccagtcgctggcgaccgcaatgacgcgtagcgccagccatgctccgctggatctggtgaaagatcttaaagcgaacggggctgataccgttattgggccgctgaaatgggatgaaaaaggcgatcttaagggatttgaatttggcgtcttccagtggcacgccgacggctcgtcaaccgtcgcgaagtaatgccagaagataagttatcccaccgcccgcacgccgggcgggtttaaaaaggttaccttatgtccgagcagtttctctatttcttgcagcagatgtttaacggcgtcacgctggggagcacctacgcgctgattgctatcggttatacgatggtgtacggcattatcggcatgatcaacttcgctcatggcgaggtgtatatgatcggcagctacgtctcttttatgatcatcgccgcgctaatgatgatgggaatagacaccagttggctactggtggccgccggatttatcggcgcgattattattgccagcgcctacggctggagtatcgagcgagtcgcttaccggcctgtgcgcaattccaagcgcctgatcgccctgatttccgccatcgggatgtccatctttctgcaaaactacgtcagcctgacggaaggttcgcgcgacgtggcgttacccagcctgtttaacggccagtggattgtgggcagcagcgaaaacttttccgcgtccatcaccaccatgcaggcggttatctggatagtcacctttctggctatgctggcgctcaccattttcattcgctactcccggatgggccgcgcctgccgcgcctgcgcggaggatctgaaaatggccagcctgctcggcattaataccgaccgcgtcattgcgctaacgtttgttatcggcgcggcaatggcggcggtggcgggcgtgctgctcggtcagttctatggcgtgattaacccctacatcggttttatggccgggatgaaagcgttcaccgcggcggtgctgggcggtattggcagcattccgggcgcgatgatcggcggtctgattttgggcgtcgccgaagcgctctcgtctgcatatttaagtaccgaatataaagatgtcgtgtcgttcgctctgctgattctggtactgctggtgatgccgaccggtatcctggggcgtccggaggtagagaaagtatgaaaccgatgcatattgcgatggctctgttctctgcggcgatgttcttcgttctggctggcgtctttatgggcgtacaactggagctggacggcaccaaactggtggtggataccgccgccgacatccgctggcagtggatctttatcggtacggcagtggtttttttctttcagttgctgcgtccgatgttccagaaagcggtgaagcacgtctccggaccgaagtttattctgccggcgatcgatggctctaccgttaagcaaaagctgtttctgatggcgctgttggttatcgccgtggcgtggccgtttatggtgtcgcgcggtagcgtcgatatcgccactatgaccatgatttatatcatcctcggtctggggctgaacgtggtggtggggctgtccggcctgctggtattgggctacggcggcttttacgccatcggcgcttatacctttgcgctgcttaaccactattacggtttgggtttctggacctgcctgccgctggcgggactggtctccgccgccgccggtttcctgctcggcttcccggtactgcgcctgcgcggcgactatctggcgattgtgacgctcggcttcggcgaaatcgtccgtatcctgttgctcaacaacactgaaattaccggcggcccgaacggcatcagccagatccccaaaccgacgctgtttggtctggagtttagccgcaacacccgagaaggcggctgggataccttcagcaatttctttggcgtgaagtacgacccatccgaccgggtcattttcctctatctggtggccctgttgctggtggtcctgtcgctgtttgtcattaaccgcctgctgcgtatgccgctgggccgggcgtgggaagcgttgcgtgaagatgagatcgcctgtcgctcattaggtttaagcccgacgcgcatcaagctgaccgcttttactatcagcgccgcgtttgccggtttcgccgggacgttgtttgccgcccgccagggctttgtcagcccggaatccttcactttcgccgaatccgccttcgtgctggcgattgtggtgctgggcggaatgggctcgcagtttgcggtgatcctggcggcggttctgttggtggtgtcgcgcgagttgatgcgcgatttcaacgaatacagcatgttgatgctcggcggtttaatggtgttgatgatgatctggcgcccgcagggattgctgccgatgacgcgtccgcagttgaagctgaaaagtggtcaggcgaaaggagagcaggcatgagtcagccattattagcggttaacggcctgatgatgcgctttggcggtttgctggcggtcaacaatgtatcgctggaattgcgtgagcgggaaattgtgtcgctgattggccctaacggcgcgggtaaaacgacggtgtttaactgcctgaccggtttttataagccgacaggcggtacgatcacgttgcgcgagcggcatctggaaggattgccgggccagcagatcgcccgcatgggcgtggtacgcactttccagcatgtgcgcctgtttcgcgaaatgacggtgattgaaaacctgctggtggcgcagcaccagcaactgaaaacgggcctcttttccggcctgttgaaaacgcccgctttccgccgcgcgcaaagtgaagcgctggaccgcgcggcgacctggcttgagcgtattggcctgctggaacatgccaaccgccaggccagtaatctggcctacggcgaccagcgccggctggagattgcccgctgcatggtgacgcagccagaaattctgatgctcgacgaaccggcggccggccttaacccgaaagagaccaaagagctggatgagctgattgccgaactacgtaaccatcacaacaccactatcttgctgattgaacacgatatgaagctggtgatgggcatttccgatcgcatttacgtggtgaaccagggcacgccgctggcgaacggcacgccggaagagatccgcaacaacccggacgtcatccgcgcttatctgggtgaggcataagatggaaaaaacgatgttaacgtttgaaaaagtcagcgcccactacggcaagattcaggcgctgcacgacgtcagtctgcacatcaaccagggggaaatcgttaccctgattggcgctaacggcgcggggaaaacgacgctgcttggcaccttgtgcggcgatccgcgcgcctccagcggacgggtggtgtttgacggtaaagacatcaccgactggcagacggcgaaaatcatgcgtgaagcggtggcgatagtgccggaagggcggcgcgtcttctcgcggatgacggtggaagagaacctggcgatgggcggtttttttgccgagcgcgatcggtttcaggagcgtatcaaatgggtgtacgagctgtttccgcgcctgcatgaacgccgtatccagcgagcgggcaccatgtccggcggcgaacagcagatgctggcgattggtcgcgcgctgatgagccagccgcgcctgttgctgctggatgaaccgtcgctggggctggcgccgatcatcatccagcagatcttcgacaccattgagcagttgcgcgagcagggtatgaccatcttccttgtcgagcaaaacgctaaccaggcgctgaagctcgccgaccgcggttatgtgctggaaaacggccacgtggtgctatccgataccggtgatgcgctgctggcgaacgaagcggtgcgcagcgcctatctgggcggataaggcgcagtttacagctgccatctggcaaacgcgcccggtggcgctaccgcttaccggacctggcggattactcggcattcggcaaatcagtagaacatttttcgtaccaatatgttatagttgagaatagttatcaactataaccaccgaagaaggagcaaggatgatacgttcaggcgcctgcataatgggaacgctgttgttcgcggcttcgttcagtgttaacgccttaacctcaaacgattttgatccccgcgatcctgctatctggcaagaagaaaccgcaacgccttatccactggccgcaacgacctgcgaagtgcgtcatcatccggattgtgcaacgtgggaggatgaaaaatccgacattcagcgtgaacgcgagcggcgagatcagcggcgcttacaaaatctgtacaaaaagtattctcatcgtgattaactgctgacgccagccaaataacgcatgtctggtcagcattacgctgtcagacgtgccgtagctcccacttttcttttccggcgctttcactgccttgccatctctctgtcgccttactatctttttttgtaataaaaaagttatttttctgtcattcgagcatgtcatgttacccccgcgaacataaaacgcgtgatatcgcgcatcccggcacaaaaagagagataaccgatgatatcgttacgacatacagctttaggactggcgctgagtctggcatttacgggtcaggcgttggccgtcaccactattccattctggcattcaatggaaggggagttaggcaaagaagttgattcactggcgcaacgtttcaaccaggccaatccggattacaaaatcgttccggtctataaggggaactatgaacagaacctgagcgccgggatcgcggcattccgtaccggcaacgcgccggcaatattgcaggtttatgaggttgggacagcgaccatgatggcctcgaaagccattaagccggtttatgaagtgtttaaagacgccggtattaactttgacgagtcccagtttgtaccaaccgttgcaggctactacaccgatgctaaaagcgggcatctgctctcccagccctttaacagctccacgccggtactgtactacaacaaagacgcctttaagaaagccggtttagatccggagcagccgccgaaaacttggcaggagctggctgactataccgcgaaattgagagcggcaggcatgaaatgcggttacgccagcggctggcaaggctggatccaactggaaaacttcagcgcctggaacggtctccccttcgccagtaaaaacaatggctttgacggtacagatgcggtgctggagtttaataagccagagcaggtgaaacatatcgcgctgctggaagagatgaataagaaaggcgattttagctatgttgggcgtaaggacgagtctaccgagaagttttataacggtgactgcgcgatgacaaccgcgtcctccggctcgctcgccaatatccgccagtatgccaaatttaactatggcgtgggtatgatgccgtatgacgctgatatcaagggcgcgccgcaaaacgccattatcggcggagccagcctatgggtcatgcagggtaaagataaagaaacctataccggcgtcgccaaattcctcgacttcctggcaaaaccggaaaacgctgctgaatggcatcaaaaaaccggctacctgccgattaccaccgccgcctacgagctgacccgagagcagggttattacgataaaaaccccggtgcggatatcgccactcgccagatgttgaataagccgccgttacccttcaccaaaggcttgcgtctgggcaatatgccgcagattcgtaccatcgtggacgaagagctggaaagcgtctggaccgggaagaaaaccccacaacaggcgttggataccgcggtggatcgcgggaatcagttactgcgtcgttttgagaaagcgagcaaatcttaagtgtataagtgcctgatggcgctgcgcttatcaggcctacagcgtttgtaggccggataaggtgcttgcaccgccatccggcaccttccaggaaaagaaccttcatgtcatcatcccgtccggtgttccgctcgcgctggctgccgtatttactggttgctccgcagttggttatcaccgttattttctttatctggcctgcgggcgaagcgctgtggtattcgctgcaaagcgtcgatccgtttggtttttccagccaatttgtcgggctggagaatttcgtcgcgctttttcacgacagttattatctcgacgccttctggacgacgattaaattcagcgcgctggtcacgtttagcggcctgctggtctcattgtttttcgccgccctggtggattacgtggtgcgcggcagccgtttttatcagacgctgatgctgctgccttatgccgtcgcgcccgccgtcgccgccgtattgtggattttcctgtttaacccggggcggggattaatcacccatttcctcggcgaattcggctatgactggaaccacgcgcaaaacagcggtcaggcgatgttcctggtggtatttgcgtcagtctggaagcagattagttacaactttttattcttctttgccgcgctgcaatctattccccgctcgctggtggaagcggcggccattgacggcgccgggccgattcgtcgtttcttccggctttctttgccgcttattgcgccggtcagtttcttcctgctggtggtcaacctggtgtatgcctttttcgacaccttcccggtgattgacgccgcgaccgccggcgggccggtacaagccaccacgacgctgatttataagatttattgcgaagggtttaccggcctggatctctcggcgtccgccgcgcagtcggtggtgttgatgttcctcgtcatcattctgacggtggtgcagttccgctatgtggaaagtaaggtgcgttaccaatgatagagaatcgtcgcgggctgacaatattcagccataccatgctgattctggggatcgcggtcattttgtttccgctgtatgtcgcgtttgtcgcggcgacgctggacgaccgcgcggtgtttgagacgccgatgacgctgcttcccggcacgcagttactggagaatatcaaaactatttgggtcaacggcgtcggtgttaatagcgcgccattctggctgatgatgcttaacagtttcattatggcgttcagcattacggtaggcaaaatcacggtatctatgctttccgcattcgccatcgtctggtttcgttttcccctgcgtaacctgttcttctggatgatttttatcaccctgatgttgccggttgaagtgcgtatcttcccgacggtggaagtgatcgccaacctgaaaatgctcaacagctatgccggtctgacgttaccgctgatggcgtccgctaccgccactttcctgtttcgtcaattcttcatgacgcttccggatgaactggtggaggcggcccgtattgacggcgcgtcgccgatgcgctttttccgcgacatcgtgttgccgctgtcaaaaaccaacctggcggcgttattcgtcatcacctttatctacggctggaaccagtatctgtggccgctgttgattatcaccgacgtgaatcttggcactgccgtagcgggtatcaaagggatgatcgccactggcgaaggtaccacgcaatggaaccaggtgatggcggcaatgctgctgactctgattcccccggtcgtaattgtgttagccatgcaacgggcgtttgtgcgtggtttagtggacagtgagaaataaaaatggctggtttaaaactacaggcagtaaccaaaagctggggcggcaaaacccaggtcattcaaccgctgacgctggacgtggcggatggcgaatttatcgtgatggtcgggccgtccggctgcggcaaatcaacgttgttgcggatggtggccggtctggaacgcgtgaccagcggcgatatctggattgatcgcaaacgggtcaccgagatggagcccaaagatcgcggcatcgcgatggtatttcagaactatgctctctatccccatatgagcgtagaggagaacatggcgtgggggctgaaaattcgcggtatgagcaaagcgcatattgaagaacgcgtgcgggaggcggcgcgcattctggagctggacggcctgcttaaacgccgtccacgcgagctttccggcggtcaacggcagcgcgtggcaatggggcgcgcgatcgtccgcgagccggcagtctttttattcgacgaaccgctctctaacctcgacgccaagctgcgcgtgcagatgcgtctggagttacaacatctgcatcgtcgccttcgtaccacctcgctctatgttactcacgatcaggtagaggcgatgacgctggcccagcgggtgatggtgatgaataaaggcgtcgcagaacagattggcacgccggtagaggtgtatgaaaaaccggccagtcgcttcgtggcgagctttattggcagcccggcgatgaatctgttggacggcgttatcagcgcttccggcgaccgtttcgaattgcctggcggtctggcgttgccgattggtgcgggctatcggggtcatgctggacgtaaaatgacgctgggtatccgcccggagcatattgcgttaagctcgcaggcggaaggcggcgtgccgttaacggtagacacgctggagattctgggcgcggataatctggcgcatgggcgctggggcgatcagaaactggtggtgcggttggcgcatcagcagcgcccggcggcgggcagtacgctatggctgcgtctgccggaacatcagcgacatctttttgatggcgaaacaggacaacgtgtatgagtaactggccttatcctcacattgtcgcccatcgcggcggcggtaaactggcgccggaaaacactctggcggcgattgacgtgggcgcgcgatacgggcacaccatgattgagtttgatgccaagctgtcgaaagacggcgaaattttcctgctgcatgacgataacctggagcgcaccagcaatggttggggtgtggcgggcgagttgaactggcaggatttattgcgtgtggacgctggcggttggtttagcggcgaatttaaaggcgagccgctgccgttgctctcgcaggtggcggagcgctgccgtaaacacggcatgatggcgaatattgagatcaaaccgacaacggggagcggaaggctaacaggacgtgtcgtggcgttggccgcccgcgaactgtgggccgggatgacgccgccgctgctttcttcctttgagatagaggcgctggaagcggcgcaggcggcagtacctgaactgccgcgcgagttactactggataaatggcgtgaagactggcgtgaactgacgacccgtctgggctgtgtttccctccatctcaaccataaattactcgatgagacgcgagtgcaagagattaaggccgcgggtctgcggattctggtgtataccgtcaatcagccccagcgggcggcagagctgctgcgctggggcgtggattgtatctgcaccgatcgcattgatgacatcggccctcactttcagttttaagggctgatagttttcagcgggatgtcaggctgcggcgtcccgctgtcctgctgcaacattggctgggaatggtttagcatccggtccggatttccgctgccgctgagcattccgccctgcgtattgggcagcgtttgctgaccgagcataccgttgcccggctgtccctgctgaacccgctgcgtattggcattcaactgcgactgtagattttgctgctggctgcgcgcctgcgtttgcatctgcgtctgcatacgctgctggctggggatttgataacctggctgattaggattattcatagtgttaattggctgggccaatacagcaaagggtaataaagccgtaataagtagtaagcgtttcattgtcgtctcctcccgatgaggcctctttttaagtgtacctctatttcgccatgatgatgattttttaagcgttgtggaccaggattaaacgggacatacacccctttatctggagaaaaacaacgatgaaaccaacgtttatgcgctgggtggcgatcgccgctctgctggccggggggacgtttagcgcggtggccaatcctcccgtcgcgccgccagtctcctatggtgttgaagaagatgtctttcatcctgtacgggcgacgcaagggatggtggcgtccgtggatgcaatggcgacgcaggttggcgtggatatcttaaagcagggcggtaatgccgtggatgccgccgtcgccgtgggctatgcgctggctgtcacgcatccgcaagccgggaatctgggcggcgggggatttatgctgctgcgcactaaagatggcgctaccacggcgatcgattttcgtgaaatggcgccggctgccgcgacccgtgatatgttcctcgacgatcagggtaacgccgatgcgaaaaagtcgctgacgtcgcatctggcatccggtacgccgggtaccgtggcgggtttctcgctggcgctggagaaatacggcacgatgccgctgaataaagtggtgcgtccggcgatgaagctggcggaagagggttttgtggttaacgatgcgctggccgacgacttaaaaacttacggcagcgaagtgatccccaaccatgagaacagcaaagccattttctggaaagacggcgagccgctgaaaaaaggcgataagctgatccagaagaatctggcgaaaagcctggaaatgattgccgaaaacggcccggctgcgttttataaaggggcgattgccgaccagattgccggggaaatgcagaagaacggcggtctgatgaccaaagagaatttagccagctataaagccgttgagcgtacgccaatcagcggtgactatcgcggatatcaggttttctccatgccgccgccgtcctcgggcggtattcacatcgtgcaaatcctcaatattcttgaaaatttcgacatgaagaagtacggctttggcagcgccgatgccatgcaaatcatggcggaagcggaaaaatacgcctacgctgaccgctcagagtatctgggcgatccggactttgtgaaagtgccgtggcaggcgctgaccaacaaagcctatgcgaaaacgttggccgatcaaatagatattaataaggcaaaaccttccagccagatcaaaccgggcaagctcgccccgtatgaaagcaaccagaccacccacttctcggtggtggataaagacggcaatgctgtgacggtgacctataccctgaacaccaccttcggcacaggaattgtggcgggaaataccggtattctgctgaataatcaaatggatgatttttctgctaagcctggtgtacccaatgtttatggcctagtgggcggcgatgctaacgcggtcgaaccaaaaaaacgtccgctgtcgtcgatgtcgccgactatcgtggtaaaagacggcaaaacctggctggtgaccggtagccctggcgggagtcgaatcatcactactgtgctgcaaatggtagtgaacagcattgattttggcatgaacgtcgccgaagcgaccaacgcgccgcgtttccatcatcaatggttgccggacgaactgcgggtagaaaagggcttcagccccgatacgctgaagttgctggaacagaaagggcagaaagtcgcgctgaaagaagcgatgggcagcacccaaagtattatggttggaccggatggcgaactgtacggtgcgtctgacccgcgttccgtggatgatttaacggcgggatactgatttttaattccaggcccggtgtcagacaccgggctatttgcagattatgccgtgagtaatcgggctggattatcaatacaaagcttgcgcagagtatcgttgtctactccgcgagcagccaaataggcgaggaaaacattcgggacaaacccccagccatttccgccatttttcgcccacatctgtttgagaaaaacatcatggcttaaaacgatttggtcggcgtaacccagtgcaatcagattcgctactgcatctgcggtctcctgaacgcccggcgcgacaccttcttttggaaaggtgatgtccagaccaatcatgtcaaattcaagccatacgccgcggtcgagcattttacgttgatagacgacatcttttcctgaagggtccgaatgcgccagcgagacttttgccggagagacgttcatttcttccagcacgatatccagcacctcatcacccagtcgcagccaccctggcatatggatattcatcgccgtgtgggggttgttacattgtgccagagacgctgcccgcaggctgttacgctccgcttgggtaaacgcgggagatacgccgatttcaccgatcatgccagcgcgaatatccgtctcgccaataccctgattcagttctttatcaatgagtgaggctaacagctcaacaggtttatggatccgggtgctttcaaatttctccagataaggcccggatgacgcaacgatattcaaacccgtttttaaggcaacttctcgtagcgctgaggcatcccgtccaatggattctgaaccggtggcgtcgacaatcgtcctgccgcccaaagacataaagttattgatttcgaagataacatcatcaatctcttttctgtccatgttatcggcgcagcagtatgggtcgtgtttcagcccccactgcaggtcagcactgactttctttcccaccagttgctgtgaaaaagcataatgtggctcgtctacgaccgaagacagatcgttaaacagatgttcatgcggtagcgtcagccccatatccgtatgcgccaccgggcctgttacggtttgcaggaaacctttcattctgacacctccattttttgcgccattttggatgctctgtattcagggatggtggtcacaatcgcaccgactaacgcgaacagcgtaccgatgatggtgaccaggtagaccgtattgcctaatgaagggatcaattcatcaattagcactgagccaagcagttggcctgctgttgacgctacgcccagcatcaatagccctaagcctctcaccagaatcgccattagcccgatggatagcagacccagcggaccaccgagatacatccaccatgtatcgagtaactggatggtgacatggcctaatgcgatacgtatcgccagcgccgcgcccaggacacaaaagccgacgatgaagttccatgtaatggacaccagcatggagcccgttgcctcggcgactttcgcattccccgcaggctgccagccagcgagtaaccctgccaaaaaggggaggatagcgagcaggataaacgaggttgagtgccactgtggcgacacgacaaaaatggtggcgataacggcgaacaatgcgccagtaatgcgccatggcgtaaaatattttttctcctccacgccgatgccaaaacggtcgcacagcaggccggaaagaagcagagcggaaattaatgccgtttgaaaggtggcaacgcccagcgcgctggcggatgcgccttcagaaaatacgaccatcgccccgcataatcctgcaaaccaattccatagcgggatttttctctttttaatcagagtagggattgaggcgaattgctggcgtgtttctttgcgcgcaataataataaaaaacatgacgaccagaccgctggcaaacgagattactgcgcaagcattaccgtcttgtaaccaatgtcctaactgcccattaacggcagactgcatcggggaaagcataccggctaagatggtggcaagcatcagtaagggggttgagtacttattcttgttcatacatcaatccttatattttataaaaggagtaactttcgttactccattgttttttattttctggcgatgaattgaagcgtgttgacccacaggtcggtataaaatggccatgacataaactgctgggttccccagtgtggggagcagtcactcataaagcaggcggttttaccctgttggtattcaccgaacactaacaatgggtcattatttattgttaatacgacatcggcatcgtctctggcgacgacctggttatatccaagaaataccgggtaatctgagaacccgttaacaacaggatgttcaggtgagacagcctcagcacaaataccctctggcttttctacccggtcatcgccgtcaagcataataactggcagaacctcagcaagaacggtgttcttataattggcttttgcctcaatacccataaatgacagataaccgccaatcatgagtagtccaccgccatttttgacgtactctttaatggattccagagcgtttggttttatttttagctgatagaaggtttcattttgtagcaggaaggtattactaccaatgtcgctaataacaatcacatcataacgatttaattcgtcaatactctctggaaaggcaatttgtaccgtgtgggcaggcatgtaatcaatatcaacgccgcctttcctcaggcattccagtaaccatgtcgcgccttcttcatatttactggaggtgaaactgtcataaccttttgaatgaatcatatgaatatgccaggattctccaataaagagcacctttagttttttctgcgtattgttcatagtctgctccttgatttagtgagtagagatagtttgtttgtaatgtgaaccctgaatacgatgaagaacggagtcgttttccggcatatcagaggcattaggcgtttcaaccgcaagtgaggcaaatgcgctggcgtagcacaatgcggatgccagtgactttccttttgcaaggccagatgagagggcgccattgaaagcgtcacccgctcccgccgtattttttacaactgccggaaatgccggggaatagatgaattgtgtgccgtcataagcaagcgaacctttgctacctaatgtaataatggtatttttgacgcctttctggtgaataattttggccgcgcatttggctgattcgatatcattaaccgccatattggccagcaggccggcttccgtttcatttggcgtaatatagtcaatgttatcaatgatggtgttaaccatgtcattgtacggcgctggattgatgatgaccggtatgtcatttttttgtgcgagacgaattgtttgctgcagcgcttcgtaattcgtctccagttggacaagaacaatatctgaatgaacaatggcttctttttgaatggtgatttcatcaggggaaattgtcatgttggcgccagggtagatagcgatgacattatctccggtatcaccattcaccatgatggttgctgtacctgtttgtgtttctttggtctggtagataacacttttatggatttttgatgagtttataaaattaatggcgtaatcgctaaaatgatctgagccgactttagtaataaaatgcacatcagaatcggcatagcttgctgctaatgcctgattacatcccttaccgccgggtgaaaaaataaatttatcggccagcaatgattctcccgttgagggtaatctcggtagataactgataatatcaacattgaacgagccaataacacatacattatttttcatggcagagagacctttttttattttctgcgctgattcatatttttccagcacataagcaatttcattttttgcgacgttatcaagagaatcaagggtaataaatgcaccaccatgacagcgagtaagatatccctgtccggcaagttcattgagatctgaacgaatagtttcctttgttaccttgagacttttcgccagatttgaaacttttacaactcccgaaatactgagttccttcaatattctatgatggcgttcaaatttcattttttacctcaccgtggttaaattagtcccgggaggagtatattgttgtgattgtcaccataaagtgatggcagaaaccaaaaaaaaacaaaaatgtaatattaatattgctaaaattacggaaaaaacggtgataaagcttaaagtggtaataaccatgaaattcaagtggttattgttttgatataggggaagtaggctgcaataactggaatgttgtgaaggtttgtgacgtttcgccccacagggtggggcggggaagcgctatttcacgcgcgccataaagtacgtatcaacgtactcaccgttgcgcaggccgtatttcttaccggtgccttcgatttcaaagccgtacttcttatacaccgccaccgcgggctcgttatcaacaaacaccgttaactcaatacgctcgacgcgcagccagttgtcacacatgtcgatcatcgtgcggatcagcgcgctggcaatgccgcgattgtgccaccgggcatccacgcagataccaaaatcggccacgtggctgcgacggggacgttgggtgacctgaatagaaagatggccaacgacaatatcgtcaatgcaggcaaccagttgtttaaccccggcttgctcggttagccgcgcctgccacatttcgagggaaggatgaggaacctgtagcgtgttgtggtacacctccggctgggcgtggatctgacgaatggcgtcgtaatctttcggttcagcgtggcgtatcactatttcactcattccttatctcctgcagggttaattgtgtatttacactcgctgagaaagaaaattccgtcaaccgcatttttttgcaaaaagaagtagacaagtgcgaatgagaatgattattattgccttgcattcaggggaacccctacggataacctgaaagcatgacattgctcacattgcttccagttttattttggccagcttttgctggctttttttttggttttgtttcagcctggcttacttgtcattttgtccccgggaagtgctcgtgctcctcacgtacatttagtacgctccgggccctgcgcgcttgccgtgaacaaactgaccgcgacgctgacggccgatcttgaggcatctgcttttgtaggcccgaaaaggcttctccgccaccgtcaaagaatccaacattcagtctcctcacgctttgcgctatggtgtaaacaatcatcttcaaaaggatcgtctcatgaccttacactgcgcatttattggattcggcaaaagtaccacccgttaccatctcccctacgttctgaatcgtaaagatacctggcatgtcgcgcatattttccgtcgtcacgctaaaccggaagagcaggcgccgcagtattcgcatattcacttcaccagcgatctggatgaggtgttgggcgatccgcaggtaaaactggtgatcgtctgtacgcatgctgacagccatttcgaatacgccaaacgcgcgctggaagcgggtaaaaatgtgctggttgagaaacctttcacgccgacgctggcggaggcaaaagtgttgttcgaactggcgcgaagcaaaggactgaccgtcacgccatatcagaatcggcgttttgattcctgttttctcactgctaaaaaagcgattgagagcgggaaactgggcaagattgtcgaaattgaaagccatttcgattattaccgcccggtagcagaaaccaaaccgggcctgccgcaggatggcgcattctatggacttggcgtccacactatggatcaaattatttcgctatttggccgcccggatcatgtcgcgtatgacattcgtagcctgcgtaataaagcgaatccggatgacacctttgaagcgcaattgttctacggtgccctgaaagccattgtgaaaaccagccatctggtgaaaatcgactatccgaagtttattgttcacggcaccaaaggttcgtttgtgaaatacggtatcgatcaacaagaaaccagcctgaaagcgaacattatgcctggcgagccgggttttgccgctgacgaatccgtcggtgtgctggaatatgttaacgatgaaggcgttacggtgaaagaagaggtgaaaccggaaacgggtgactatggtcgcgtctatgatgcgctgtaccagacgttgaccatcggtacgtctaattatgtcaaggaatctgaagttcttaccaatctggaaatcctcgaacgtgccttcgaacaggcaacgcctgcgacgataaccctcgctaaatagcccttacagactcctctgcgcttattcatattttttgaacagaggagtcaattttcaccctctatgatcccggacggaatgagtccacacttattccatcgaaaacatctgggggtgaacacaatgatctacttacgcaaagcaaacgaccgcggtcatgcgaatcatggctggcttgactcctggcataccttttcttttgccgattattacgatccgaactttatggggttctcggcgctacgtgtgattaacgacgatgtgatcgacgcaggccagggtttcggcacgcatccgcataaagacatggaaattttgacctatgtgctggaaggtgctgtagaacaccaggacagtatgggcaataaagaacaggttccggcaggtgaattccagattatgagcgccgggaccggcgttcgccactccgagtacaacccgagcaaaacggatcgtctgcggctgtaccagatctggatcattccgcaagaaacaggcatcacgccgcgctacgaacagcgccgcttcgacgccgcgcagggcaagcaactggtgctttcgccagatgctcgcgatggttcgctgaaggtccaccaggatatggagctgtaccgctgggcgctgctcaaagatgagcaatcggtgcatcagattgccgccgagcgccgcgtctggatacaggtggtaaaaggtaacgtgaccattaacggtaccaaagcgacgaccagcgacggcctggcgatttgggatgagcaggcaatctcgattcatgccgacagcgacagtgaagtgttactgtttgacctgccgccagtctaaaaatacacgtcatccttcaagctgcatctgtgttggctttattactcggcccatccataggcctcgccccttcggggccgctgcgagcagcgttcaaatctgctcccggcagatttgtcgctcaccccggtcgcgtacttaatgtacgctcccggggatttactgagggacatccttgtccctcaccagaggcaaccttcggttgttcaaattcgttcctgacgaatttgtcactgcgtcgccgccttgatgcaactcgaatgattttgtgtatttctcataataaaaactcctttttctctgcgaaggttcacgcacgtccgtggtaaactggggaaatctatccctttttaacgcttcaggacgatgaaaaagaaaagacccgtacttcaggatgtagccgaccgcgtgggcgtgaccaaaatgacggtcagccgctttttgcgtaacccggagcaggtctccgtggcgctgcggggcaaaattgccgctgcacttgatgagctgggttatattcccaatcgcgctcctgatatcctttctaacgccaccagtcgcgctatcggcgtgctgttaccgtctctcaccaatcaggtctttgcggaagtgttacgcggcattgaggccgtcaccgatgcccacgggtatcagaccatgctggcgcactacggctataaaccggagatggagcaggagcgcctggaatcgatgctctcctggaatatcgacggtcttatcctcacagaacgtacccatacgccgcgcaccttaaaaatgatcgaagtcgccgggattccggtggtggaactgatggacagccagtcgccgtgtctcgatattgccgttggttttgacaacttcgaggccgcccgtcagatgaccgccgcgattatcgcgcgtggtcatcgtcatatcgcctatctgggggcgcgcctcgacgaacgtactatcatcaagcagaagggctatgaacaggcgatgcgggacgccggcctggttccttacagtgtgatgatggagcaatcttcatcctactcttccggtatcgaactcatgcgccaggcgcgacgcgaatacccacagcttgacggtattttttgcaccaacgatgacctggcggtgggggcggccttcgaatgccagcgcctggggctaaaaatcccggacgacatggcgatcgccgggttccacggtcatgacatcggccaggtgatggaaccgcgtctggcaagcgtcctgacgccgcgcgagcgaatgggcagcattggcgcggaacgtctgttggcccgcattcgcggcgaaacggtcacgccgaaaatgttagatttaggtttcaccttgtcaccgggcggatctatttagtctgacaactttgaagtagctcacacttattcacttttggcacgaatggtcattgcgtcgtgaatggtgcggttggacaatgttaccgataacagttacccgtaacaaattttgcaacttgtagagtggggtcccgctttgagcacgactaatcatgatcaccacgtttacgttctgatgggcgtatcaggcagcggtaaatccgctgtcgcaagcgccgtggcgcatcagcttcatgccgcgtttctggacggcgattttctgcatccgcgctgcaatattgaaaaaatggcttccggcgagccgttgaatgatgatgaccgcaaaccgtggttgcaggcgctgaacgacgccgctttcgcgatgcagcgtaccaataaaatctcgctgattgtctgttccgcactgaaaaaacactatcgcgacctgctgcgcgagggaaacccgaatctctcctttatctatctgaaaggtgatttcgacgtcattgaaagccgtctgaaagcgcgcaaaggtcatttcttcaaaacccagatgctggtgacgcagtttgaaacgctgcaagaaccgggtgccgacgaacgcgatgttctggtggtggatatcgaccagccgctggaaggcgttgtggcgagcaccattgaggtcatcaataaaggcagtacgctgtgagtacattaacactggttttaaccgccgtcggttccgtcttactgctgctgtttctcgtgatgaaggcgcgtatgcacgccttcgtcgcgttaatggtcgtctcaatgggcgcggggcttttttcagggatgccgcttgataaaatcgccgcgaccatggaaaaagggatgggcggcacgctgggcttcctggcgattgtggtcgcgctgggggcgatgttcggtaaaattctgcatgaaaccggcgcggtcgatcagatagccgtgaaaatgcttaaatcctttggccataaccgcgcgcactatgcgattggccttgccgggctgatttgcgcgctcccgctattctttgaagtggcgattgtgctgctgataagtgtggcgttctttatggcgcgtcataccggcacaaacctggtgaagctggtcattccgctgtttgcgggcgtggcggcagccgcggcgtttttgttgcctgggcctgcgccgatgctgctggcttcccagatgcatgctgatttcggctggatgatcctgattgggctgtgcgccgccattcctggcatgattatcgccgggccgctgtgggggaattttatcagccgttacgttgagctgcgtattcctgacgacattaccgagccgcatctgggcgaaggcaaaatgccttctttcggcttcagcctgtcgctgatcctgctgccgttggtgctggtaggactgaaaacgatcgccgcgcgctttgtgccggaaggttccaccgcttatgaatggtttgagtttatcggccaccccttcactgcgattctggtcgcttgtctggtagcgatttacggcctggcgatgcgccaggggatgccgaaagacaaagtgatggaaatctgcggccacgcgctacaaccggcgggcattattctgctggtgattggcgcaggcggggtgttcaaacaggtactggttgactccggcgtcggcccggcgctgggcgaagcgttaaccggtatgggactgccgattgccattacctgctttgtgctggcggcggcggtgcgcatcattcagggttccgcgaccgtggcgtgtttaaccgcggtcggtctggtgatgccggtcattgagcaactgaatttctccggcgcgcagatggcggcgctctctatctgtatcgccggcggttcaattgtggtttctcatgttaacgacgctggcttctggctgttcggtaaatttaccggcgcgaccgaagcgcagacgctgaagacctggacgatgatggaaactatcctcggcacggtcggcgcgattgtcgggatgattgctttccaactgctgagctgagtcttgttgcccggtggcgctgtgcttaccgggcctggaaacgggcacatatcgataccgtaagccgggtaaggcgtaatcgctacccggtttttttattgaggtgtgcatggcaatcgcccaatgacattttgcctcgccatgtttcagtacgcgcataaaagcaggcaaatttctacgctgatccataattaggatcaataaaacagcgacggaaatgattcccttcctaacgcaaattccctgataatcgccactggactttctgcttgcgcggtaaggcaggataagtcgcattactgatggcttcgctatcattgattaatttcacttgcgactttggctgctttttgtatggtgaaggatgcgccacaggatactggcgcgcatacacagcacatctctttgcaggaaaaaacgctatgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgacgcggcttctacgctgcgcatgaaagatgatgccattattattctcgacccggtcaaccaggacgtgattaccgacggactgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccaaatggggcagttgtatggccatgtcgccgatgaactggcgacgccgtcttccgcaattcttgatattgaacgcaaagttacggcattgacccgcagcggcgagctgccggtggataactttggcgtaccgctggcgggaagcctgatcccctggatcgacaaacagcttgataacggccaaagccgcgaagagtggaaaggccaggcggaaaccaacaagatcctcaatactgcctctgtgatcccggttgatggtttgtgcgtgcgcgtcggcgcgctgcgctgtcacagccaggcgttcaccattaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcgtagtggctattgcagcgcttatcgggcctgcgtgtggttctgtaggccggataaggcgtgtcagcgccgccatccggcaatatccgccagataaggcgtagtcggcaagcagacgtcagattgatatgtagggtgcatcgtcacctttttttgcgtaatacaggagtaaacgcagatgtttcatttttatcaggagttaagcagagcattggctattctttaagggtagcttaatcccacgggtattaagcctaacctgaaggtaggacgacgcagataggatgcacagtgtgctgcgccgttcaggtcaaagaagtgtcactacctgatgttgaattcagtgagatggagtgacgccacaaaacaggataacaaaccatgtccagtcgtatcgatagagacgtgattaatgcgctaattgcaggacattttgcggaccctttttccgtactcggaatgcaccagacccaagccggactagaagtccgcgccctattacctgacgccaccgacgtatgggtgattgaacccaaaaccggacgtaaagtcggcaaactggaatgtctcgacgctcgcggttttttctgcggcgttttaccccgacgtaaaaatttctttcgctatcagctcgccgtgacctggcacggacagcagaacctcatcgacgatccttaccgttttggtccattaatacaggaaatggatgcctggctattgtcggaaggcacccacctgcgtccttatgaaacgctgggcgcgcacgccgatacgatggatggcgtcaccggcacccgtttctccgtctgggcgcctaatgcccgtcgcgtttcggttgtcgggcaattcaactattgggatgggcgtcgccacccgatgcgtctgcgcaaagagagcggtatttgggagctgtttatccccggcgcgcataatggacaactgtataaattcgagctgcttgatgcgaacggtaatctgcgcattaaagccgatccctatgcttttgaggcgcagatgcgtccggaaacggcgtcgatgatttgcggactgccggagaaagtgacgccaagcgaagaacgacaaaaagccaatcagtttgatgcgccgatctcgatttatgaggtgcatttaggttcatggcgccgccatacggataacaatttctggctgagctatcgtgagctggcggatcagcttgtgccttacgccaaatggatgggctttacgcaccttgaactcttgccggttaacgaacatccgtttgacggcagttggggctaccagccgaccggcctctacgcgccgacccgccgctttggtacgcgggacgacttccgctatttcatcaatgcggcccatgcggcgggccttaacgtcattctcgactgggtgccgggccatttcccgtccgatgaatttagcctcgcggagtttgacggcacccacctctatgagcatagcgacccgcgcgagggctatcaccaggactggaatacgctgatctacaactatggtcgtcgtgaagtcagtaattatctggtgggtaacgccctgtactggatggagcgttttgggattgatgcgctgcgtgtcgatgcggtggcctctatgatctaccgcgactacagccgcaaagagggcgagtggataccgaacgagttcggcggtcgtgaaaacctggaagccattgagtttctgcgtaataccaaccgcattattggcgagcaggtgcccggcgcggtcagcatggcggaagagtcgacagacttctctggcgtgacgcgtccaccggaaacgggtgggctggggttctggtacaagtggaatctgggctggatgcacgacacgctggactacatgaagctggacccggtgtaccgccagtatcatcacgacaagctgacctttggtatgttgtacaaccataccgaaaactttgttctgccgctgtcgcacgatgaggtggttcacggcaagaaatccattctcgatcgtatgccgggcgatgcgtggcaaaaattcgccaacctgcgcgcctattatggctggatgtgggccttccccggcaagaaactgctgtttatggggaatgagtttgcccagggacgcgagtggaaccatgacgccagcctcgactggcacctgctggaggggggcgataactggcaccacggggttcagcgtctggtgcgcgatctcaaccacacctatcgccaccataaagcgttgcatgagctggatttcgatgcttacggctttgagtggctggtggtcgatgacaatgaacgctcagtactgatttttgtacgccgtgataaagccggtaacgagatcatcgtcgccagcaactttacgcccgttcctcgccacgactaccgctttggcatcaaccagccgggacgctggcgtgaaattctcaatactgattcgatgcattatcacggtagcaacaccggcaatggcggtgtggtgcacagcgatgagatcgaaagccatggccgtcagcactctcttaacctgacgttaccgccgttggcgacgatctggctgatgcgggagggggaatgacgcagcttgcgatcggcgaagcaacgccgcatggcgcaacgtatgacggtcatggcgtgaatttcacgctcttttccgcccatgcggagcgcgtagagctgtgcgtttttgattcccgagggaatgagcgtcgctatgacctgccaggacgtcgcggcgatgtctggcatggttatctggcaggcgccaggccaggtttgcgctatggctatcgcgtacatggcccgtggcagccagcgcaggggcatcggtttaatccggcgaagttactgcttgacccttatgcgcgccaagtcgagggcgaactaaaagatcatccgctgttgcacggcggacacgatgaaccggactaccgcgataacgcggcggtggcgccgaaaagcgtggtaatcagcgaccattatgactgggaagatgacgccgcgccgcgcacgccgtggggaaaaacggtcatctatgaagcgcatgtcaaagggcttacctatctgcatccggaactcccccaggagatacgcggcacctataaagcgctcggtcatccggtcatggtggcgtacttcaaacagcttggcattacggcgctggaactgttgccggtggcgcagtttgccagcgagccgcgtctgcaacgtatggggctgaccaattattggggttataacccaatggcgatgtttgcgctgcatcccgcctgggccagttcgcccgagacggcgctggacgagtttcgcgatgcggtgaaagcgctgcatcgcgcggggattgaggtcattctggacatcgtattaaaccatagcgccgagctggatctggacggtccaaccttctccctgcgcggaattgataaccgtagctattattggataagggacgatggcgattatcacaactggacggggtgcggcaacacgctcaatttaagccatcccggcgtggtggaatacgcgtgcgagtgtttgcgctattggatggaaacctgtcatgtcgatggttttcgttttgatttggcgtccgtcatggggcgcacgccgacgtttcgccaggatgcgccgctgttcgccgcgattaaagcgtgtcctgtgttatcaacggtcaagctgattgctgaaccgtgggatattggcgagggcggctatcaggtcgggaattttccgccaccgtttgccgagtggaacgatcattttcgcgatgcggcccgccgattctggttgccgcgtaacctgacgaccggggagtttgcctgtcgtttcgccgcttccagcgatgtgtttaaacgcaatggccgcgcgcccggcgcctctgtcaatctgctcacggcgcatgacggttttacgctccgggactgcgtctgtttcaatcagaaacacaatgaggcgaacggtgaggaaaatcgcgacggcatcaacagcaattacagcgacaatcatggtaaagaaggattaggcggtccgcttgatttaatggagcggcggcgcgacagcattcatgccctgctggcgacgctactgctctctcagggaacgccgatgctgctggcaggcgatgaacacggccatagccagcacggcaacaataacgcctactgtcaggataatgccttaacctggctggactggcagcaggcaaatcgtgggttaaccacgtttaccgccgcgctgattcgtttgcgtcagcagataccggctttaaccggcaatagctggtgggaagaaggcgatggcaacgtgcgttggctaaataaaaacgcgcaacccttgagtgcggatgagtggcaaaacggacctaagctgatgcaaattctgttgtcggaccgttttctgattgcgataaatgccacgcttgaggtgacagatatagttttacccgaaggggaatggcgcgccgttcccccattcgctggagaggataatccggtgataacggcggtctggcagggactgtgtgtgttccagagaggataaaaaaggagttaatcatggtgagtttagagaagaacgatcgtgtaatgttggcgcgccagctgccattgaaatctgttgccctaatcctggccggcggccgcggcacgcgtctaaaagatttaacgaacaaacgcgccaaaccagccgtccactttggtgggaagttccgcatcatcgatttcgccttatctaattgtctgaactccgggattcgccgtatcggcgtgatcactcagtatcagtcccacacgctggtgcagcatattcagcgcggctggtcattgtttagcgaagagatgaacgaatttgtcgatctgctgccagcccaacagcgtatgaagggcgaaaactggtatcgcggcacggcagacgcggtgacccagaacctggatattattcgttgctataaagcggaatatgtcgtcatcctggcaggcgatcatatctacaagcaggactactcgcgtatgttgatcgatcacgttgaaaagggcgcgcgttgcacggtggcctgtatgccggtgccgatcaaagaagcgacggcgttcggcgtgatggcggtcgatgaaaacgacaagattattgattttgtcgaaaaaccggcgaatccccccgcaatgcctggtgacgccagcaaatcgctggccagtatgggcatttacgtttttgacgccgattacctgtatgaattgttggcggcagacgataaagatgacgcttccagccacgatttcggtaaagacattatccccaaaatcacccgcgaaggtatggcttacgcgcatcctttcccgctctcctgcgtgcagtccgatccacaagccgaaccgtactggcgtgatgtaggtacgctggaagcttactggaaggcgaacctggatttagcctcggtgacgccggagctggatatgtatgaccagaactggcctatccgtacgcatatggaatcgctaccgcctgcgaaattcgtgcaggaccgctccggtagccacggtatgacgctgaactcgctggtctccggcggctgcattatctctggttcggtggtggtgcaatctgtgctcttcccacgggtgagaataaattctttttgtaatattgattcggcagtgttgttacctgaggtttgggtagggcgctcttgccgtttacgtcgctgtgttattgaccgtgcctgtattatcccggaaggcatggtgattggtgaaaatgcggaagaggacgctcgtcgtttctaccgttcagaagaaggtattgtactggtcacgcgtgaaatgctgcgcaaactgcaggtcaaacaggagcgataatgcaggttttacatgtatgttcagagatgttccccctgctgaagactggggggctggcggatgtgataggcgcgttgcctgcggcacaaattgcggatggtgttgatgttcgcgttctgcttcctgggtttcccgatatccgtcgggggatacccgatgcgcatgtggtgagccgccgcgatactttcgcaggtaagatatcgctgctgttcgggcattataacggcgtgggcatttatctgatcgacgcgccgcatctgtacgagcgtccaggcagtccctatcacgatacgaatttatatgcctatatcgataacgtgctgcgctttgccctgttagggtgggtcggctgtgaaatggcctgcggacttgatccattctggcgccccgacgtggtgcacgcccatgactggcacgccgggctggcgcccgcctatctggcggcgcgcgggcggccggcgaaatcggtctttaccgtacacaacctggcctatcaaggcatgttttatgcaaagcatatggatgacatcgagctgccgtggtcattctttaatatgcatgggctggagttcaacggacaactctcctttttgaaggccggtttgtactatgccgaccatattacggcggtgagcccgacctatgcgcgtgaaattaccgaaccgcagtttgcttatggtatggaaggcctgttgcgtcagcgtcatctggaagggcgcttgtccggcatactgaacggcgtggatgagaagatctggaacccggaatccgatctgctgctggcgtcgcgctacacgcgcgataccctggaagagaaggcggaaaacaaacgtcagctacaaattgcgatggggttgaaggttaacgacaaagtgccgctgttcgccgtggtaagccgtctgaccaaccagaaaggtctggatctggtgctggaggcgttaccggggctgctggagcagggcggccagttggcgctacttggcgcgggcgatccggtgcttcaggaggggttcctcgcggcggcggcggaacacccagggcaggctggcgtacagatcggctatcacgaagctttctcgcatcgcattatgggcggcgcggacgttattctggtgcccagtcgtttcgaaccgtgcggcttaacgcagttatatggcttaaagtatggcacgctgcctctggtgcggcgtaccggggggttggccgatacggtctccgacagttcgctggaaaatctggcggacggtatcgccagcggttttgtctttgaagacagtaatgcctggtcgttgctacgcgcgattcggcgtgcttttgtgttgtggtcacggccttcgctttggcggtttgtacaacggcaggcgatggcgatggattttagctggcaagttgccgcgaaatcataccgcgagctgtactatcgcttgaaatagtcatccaggaatcatttatatgaatgctccgtttacttatgcatcgcccacactcagcgttgaggcgcttaagcattctattgcctataagctgatgtttacgattggtaaagacccggtcattgccaataaacacgaatggctgaacgccacgttgttcgcggtgcgcgatcgtctggtggagcgctggctgcgttctaatcgagcccaattatcgcaggaaacccggcaggtttattacctgtcgatggagtttttgattggtcgtactctttctaacgcgctgctctcgctgggcatttatgacgacgttaaaggcgcgctggaggccatgggcttagatctcgaagagctgatcgatgaagagaatgacccagggcttggcaacggcggcttaggacggctggcggcttgcttcctggactcgctggcgacgctaggattaccgggtcgcgggtatggcattcgctacgactacggcatgtttaagcagaatattgtcgacgggcggcaaaaagaatctccggattactggctggaatatggcaacccgtgggagttcaagcgccacaatacgcgctataaggtgctttttggcgggcgcattcagcaggaaggtaaaaaagcgcgctggattgagacggaagagattctggccgtcgcgtatgatcagatcatccccggttacgacaccgacgccactaacacactgcggctgtggaatgcgcaggccagtagtgaaatcaacctcggtaaattcaaccagggcgactactttgcggcggtggaagataaaaaccactctgagaacgtttcacgggtgctctacccggacgattccacctattccggacgcgagctacgcctgcgccaggagtattttctggtctcggcgacggtacaggatatcttgcaccgtcattatcaactgcataaaacctatgagaatctggcggataaaatcgccattcacctcaatgatacgcatccggtgctgtcaattccggagctgatgcgcctgctgattgatgaacataaatttagctgggacgacgcgtttgaggtgtgctgtcaggtcttctcttataccaaccatacgttgatgagcgaggcgctggaaacctggcccgtcgatatgctggggaaaattctgccccgtcacctgcagattatcttcgagattaacgactatttcctgaaaacgttgcaggagcaatatcccaacgataccagcctgcttggacgcgcgtcgattattgatgagtcgaacggtcgccgggtacggatggcctggctggcggtggtagtcagccataaagtcaacggcgtttctgaactccattccaacctgatggtgcagtcgctgttcgcggattttgcgaagattttcccgacccgtttttgtaacgtcacgaacggcgttacgccgcgccgctggctggcgctggcaaacccgccgctttctgacgtgctggatgagaatattggtcgtacctggcgtaccgatcttagtcagctcagcgagctgaagcagcattgtgattatccgctggtcaatcatgcggtgcgtcaggcgaagctggaaaataaaaagcggctggcggtagtgatagcgcaacaactgaatgtggtggtgaaccctaaagcgttattcgacgtgcagattaagcgtattcacgaatacaagcggcagttgatgaacgtactgcatgtcattacccgctataaccgcattaaagaaaatccggaggccgactgggtgccgcgggtgaatatttttgccggtaaggcggcttccgcctattacatggcaaaacatatcattcatctgatcaacgacgtggcgaaagtgattaacaacgatccgcagattggcgacaagctgaaagtagtgtttatcccgaactacagtgtcagtctggcgcaggtgatcattcccgctgccgacctgtctgagcagatttcgctggcagggacagaagcttccggcaccagtaatatgaaatttgccctgaacggcgcgctcaccattggtacgctggatggcgcgaacgtagagatgcaggagcatgtcggcgaggagaatatctttatcttcggtaatactgcagaagaggtggaagcgttgcgcagacagggttataagcctcgcgactattatgaaaaagatgaagagctacatcaggtactgacgcagattggtaacggcgtctttaatccggaagagccaggccgttaccgcgatctggtagattcgctgattaactttggcgatcactatcaggtgctggcggactaccgcagctacgtggactgccaggataaggtggatgagttgtatcgtcgcccggaagagtggacgacgaaagcgatgctcaacattgccaatatgggctacttctcatcggacagaaccatcaaagagtatgccgaaaatatctggcatattgatccggtgcggttgtaaatcccgatgccgacggcgcttcgcttgcccggcctacgtttatgtatccttgtaggccggatcaggcgttagccgccatccggcatttttctcaggacgccagtgaaagttggtgtttctcaacatacgccgccagccactgggtgatgcgggactgctgctcggcggtcagccacatgccttctttggtgcgacgccagatagcgtcttcagtacggcgcacccattcgtgatccaccaagtatttgagttccgcttcgtaaaactcatgaccgaaatcttcgcctaaatcaagcagtgacgtggcttcgccgagaatccactccgtgttgctgccgtaagtgcgcgaatagtggcgcgccagcgattccgtcaggaacggataacgacgacgcagcttcgccgcgtaatcttcgcggctgccgtcgatgtcgtcgccgggcagtacgcacgttttggtccatgccggcccgatgcctggataataagacgccagtttttccatcgcatgttcggccagcttacggtaggtcgtgagcttaccgccaaacacggaaagcagcggcgctttgccgttttcatcatggatatcaagggtataatcgcgagtgatcgcctgcggcgagtcggactcatcatcgcacagcggacggacaccggagtacgtccagacgatgtcatcgcgccccagttgtttctggaagtgcgcgttatagaccttcaacaggtaattaatttcgctctcttcaatttttaccgctttcggatcgcctttatattcgacatcggttgtgccaatgatcgaaaactcttccatccacggaatgacaaagacgatacgcttatctttgttttgcagaatatacgcctgtttctgattatggacgcgcggcacgacgatatggctgcctttgatcaggcggatgccatacggcgacggcaggtgcatcccttcgtcgaagaactgtttgacccacgggccggtggcgttaaccagtccgcgcgcctgccagacatattttttaccggtgtcgatatcttccgcttcgacaatccacaggccattttcccgacgagcggcggttgcgcgagtacgggtaaggacttcgccgcctttacgcaccaccatctgtgcgttggccagtaccagacgcgcatcgtctacccagcagtcggagtattcgaatccgcgcacgatttcaggtttgagtaccgaatctgcgccaaaccgcacaccggtggaaccgggtaaactggtacgtttgccgaggtgatcgtacataaacagaccgatacggatcatccaggctggacgtaagtgcgggcggtgcggcagacgaaaacgcatcgggaaggcgatgtgcggcgccattttcaacagcacttcacgttcggccagcgcttcgctgaccagacggaactcgtagtgttcaaggtagcgtaagccgccgtggataagtttcgaactggcggaagaggttgcgcaggccaaatcctgcgcttccagcatgagtacggacaaaccgcgtccggcggcatcagccgcgatgcctgcaccgttaatgcccccgcctatcacgatcagatctttggtttccatgctgccctcttgcactttcgttaaagttcaaaaatgttcgttatcgaacataatagcaaagaaacgcgctattggtaacatcgaaaaaacattttagagtgatatgtataacattatggcgttaagctactccgtcaacgtacactgggcgataaaatgccttaattggcttcaccggcaataatgaaagagcgattcatggaacaatttgaatgtatcactgtagaagaggcgtatcagaaactgcaccagggcgcggcggtgctggtcgatattcgcgatccgcaaagttatgccatgggtcatgcgccgcaggcgtttcacttgactaacgatacgctgggcgcgtttatgcgtgagcatggtttcgataccgccgtgatggtaatgtgctatcacggcaacagtagtaaaggcgccgcgcagtatctgctccagcaaggctatgatgcggtttacagcattgacggcgggtttgaggcctggcatcgccgtttccctgccgatgtcgcgaatggcgcgtaatcccataaagatgcagcctccgacgagaagggtatatatactgtcttcttttgtatggactaagcgacagcaataatgttgatgattacttcctttgcgaatcctcgcgtggcgcaggcatttgttgattacatggccacccagggcgtcattcttactattcagcaacataatcaaagcgatatctggctggcggatgaatcgcaggccgaacgtgtgcgggtcgagctggcgcggtttatagaaaatcccggcgatccgcgttatctggcggctagctggcagtccgggcagactaacagcgggctacgctaccgccgttttccctttctcgccacgctgcgtgaacgagccggccctgttacctggatcgtgatgctcgcctgcgtggtggtctatatcgcgatgagtctcatcggcgatcagacggtgatggtgtggctggcgtggccgttcgatccggttttaaaatttgaagtctggcgctacttcacccatatctttatgcacttctcactgatgcatattctttttaacctgctgtggtggtggtatctcggcggggcggtagagaagcgcctgggcagcggtaaattaatcgtcattacggtgataagcgcgctgctaagcggctatgtacagcagaaatttagcggcccgtggtttggcgggctgtccggcgtcgtctatgcgctgatggggtacgtgtggctgtgcggagagcgcgatccgcaaagcggaatttacctccagcgcggcttaattatttttgcattattgtggatagttgctggttggtttgactggtttggcatgtctatggcgaacggcgcgcacatcgccgggcttatcgtcggtttagcgatggcctttgttgatacgctgaatgcgcgaaaacgaacgtgaggcgtatccggcctgtggtcgagatatttttccaggccgggtagggcgatgccgctatccggcgcaaggttggttactttcagagattattcatgaaacaaacacaacggcatgacgcgatcattgaactggtgaaaaaacaggggtacgtcagtacggaagagctggtggagcatttttctgtcagcccgcaaaccattcgtcgggatcttaacgatctggcggaacagaatatgattttgcgccaccacggcggcgcggcgttgccctccagctcggtgaacacgccgtggcacgatcgtaaggcgacgcaaacggaagaaaaagagcgcatcgctcgcaaagtcgcggcccagatccccaatggttcaacgctgtttattgatatcggcacgacgccggaagccgtagcgcacaccctgttagggcacagtaatttgcggatcgtgaccaacaatttgaacgtagcgaacacgctaatggcgaaagaggattttcgtattatcctcgccggcggcgaactccgtagccgcgacggcggcattattggcgaagcgacgcaggactttatcgcccagttccgtctcgatttcggcattctcggtattagcggtattgatagcgacggctcattgctggaatttgactaccatgaggtacgcaccaagcgcgcgattatcgaaaattcgcgccacgtgatgctggtggtggatcactctaaatttggccgtaacgcgatggtaaacatgggcagcattagtatggtcgatgcggtctacaccgataccctaccaccgccgggcgtgatgcaggtgattgccgaccaccatattcaattagagctgtgctaaaaagactgtcttatcaggcctacactctgcgcgcgatggtaggcctgataagcgaagcgccatcaggcacacgttaaaccccataccccatcatcttcagcaactgctgcgcgtgctgtaccgcgtcctgacggtgcgcgacgccgagtttctggtagaggttgcggatatgcgtcttaatggtggtcgcggccaccgccagttcgccggcaatctgttcgttgctgtaaccggaatagataagtcctaacacctgccattcacgctgggtgagcgggctggtgcgaataagctccgggacatccggatggttaagcagacgctcgacgaagccttcgtcaaaatgggcgaatttatgccggtgatgttggttaatatatcgcaggatgcgctgcgcgcgatgctgctccatctccggcagcgtattgagctggataagctgacgcaattgttgcgccatggcttctccttcaatcacaaaatggctgataaatccggtgcggttggcgagctgtaaggcatcaagcaatacgcgctgggcgtcgtttttccgcccggattgccagtaaagctgattgagtaacagcagattgcggtttaaatcgctcattaagcgcaggctacgggcattctcatttaactcttccagcacgatttccgcaggctcgaattcgcccagcaggatctgcgcgcgggcgatattgcgccactggccttgcagaaaatggttattggcaaacgccggttttggcgtatggcgtaaccagttggcggcggatttcttgtcgccggttaactgccagtaaatgacacgcaccttatcggcgttagagatccagtcgcagtgataacgaccattgcctaataatttttccagtcggttaagctgactacgggcattatccagatcgccgcgcgccagcgagcactgcaccagtaacgtcaggcactgcaactgttgttgcggctggaaggtggacagcacagcgataccgctgcgcgccgaggcttccgcttcgtcaaggcgcgcccacgcccacagcaattgcgcgcggatacgtaccagaaactcatgcatcggcagttgttccagatgttgctctttgatcaactggaaggctctctcctgcgtttcccatgcggcctgcaggaatccctgggcgaactgaatttcgctttgttgaattaagctccacagcgcgtaatgccagacgtcatgatggcgcgccatttgttcggtttgctgcatcagcgataaagactggctgagattgcctttacagtgcagcacttcgccgtgaacggaggtcgcgacaatgcggctataaaaccaggcgagaggaagctcatccagcgccagtttcgccagccgctctgcctcttccggattgccgtcgttgatggcgacctgggcgcgcagcgcgttaaattcagcatgcagcgtgccgtccatgacccctttgatctcttgctcggcgcgcgccagcagcgtattcacttcgctgtagcggtgttggctttgcatcagccaggcctgtaacaacaccagccgcggattttccagcaggctttcccacggcagcgcttttaatgactcttccagcagcgccagttcactgtgattaaacagcccccacgcatggttaagcaggatatcgcgcagcatttgcgcgtcacccgccgccagcgcatgatgtatagcttcgctgggaaaaccctgttccatccagctttccgcggccgcacggtggatctccggcagttccgccgccagttcccactggcaacgctggcgcagaaagctaccaaacaacgggtgatagctaaaccattcgcccgtgtcgtccatgcgttgcaggaataacccctggcgctcaatctcctccagccgcatctggccgttttcttcgccggtcacgcgcacgatcaacgcgtcattcattgcgcgtaagatcgcgcttttaagtaagaaatgtcgggtgctgacatccacgttatccagtacttcgtccaccagataatcagaaaggtggctggcattaatcccggcaagacggcgggcggagtgatgcgcagaggtatggttctggcgcgcggagagggcgatcaactgtagcgcagtggcccaaccggccacatcatcgcacatgcggctgctctcagcggcttcaatgggcgacgaaagacgacggtcaaaaaattgctttgcttcctgatggttaaaagccaactgctggctgccgatttccaacagctgatcgcgcacgcgcaggttagcgatgcccagttgcggcaaattacgcgataacaccaccagggtgaaattttccggctgatgccgtaagaaaaagcgcatcgcgtcgtgaatcaccggattggtaatcaaatggtagtcgtcaatcaccagataaagcgggcgatgccactgcgccagttcaataaagagctgtgcgaagagagacgtcaggctggcgtactgacgtttttgcgccatcgcttcgctggtagagcagtgtccgccggtggcctgttggatagcggcgattaagtaactggcgaatcgctcttgctggttatcgctttcgtcgagagagtaccagcctaattcatttttgcccgccgcccactgtgagacaagcgtggttttcccatagccagcaggactggttaccaggaggagcctgaaattgttcgcgccggaaagtttagccaacagccgctcacgaaccacggtatggtcgagacgaaccggacgacttaatttagacggaatcaacatagcaatcacttcactgtgggaaatgggggaactgcgatttttttttgcgcttcgtaattaatagatataaggtcggccagaaagcattttaatgcaagctaagcagactttttatgtgtctgaatttgcactctgtcacaattctaaataacggtattaaaaaagtattcggcgcggttgaaacgagcgtcagagctgggctgaggtcatatttccgttattgtaaataatgtcctggacaggatgcggatttaacacaatggcgataccaggcgtttaattaattatgttaagttagtgaacctcccgccgctgaatatttcaggtaataaactattttggcgttcatataatcttcgaaaatatccctccgcggtttactgttatttctgtttattcatttgattatgcgtaacactgggtgtcgttgacaggaatcggcgcgtttatacaggggtaagtggcggcgatcacacttttatgctcatccccgctcctcctccctccctaatcagtgccgggaggaggaaggtcaacatcgagcctggcaaactagcgataacgttgttttattacccgaggacggatttcctatgtcacagccaaccttcaataaagatcaattccaggccgccctgacgcgtcagtggcagcgtttcggtttactgtcggcgtccgacatgacgcctcgtcagtggtggcaggccgttagcggcgcgctggcggaattactgagcgcgcaaccggtagcgcagccgacgaaaggccagcgtcatgtgaactacatttcgatggaatttttgattggccgcctgacgggaaataacctgttaaatctggggtggtaccaggacgttagcgatgtgctgaaagcgcacgatattaatctgaccgatctgctggaagaggaagtcgatccggcgctcggcaacggtggtctgggacgtctggccgcctgcttcctcgattcgatggccaccgtcgggcagtccgctacgggctatggtctgaactaccagtatgggctgttccgtcagtcatttgttgaaggcaagcagatggaagcgccggatgactggcatcgcggcagctatccgtggttccgccacaacgaggcgctggacgtccaggttggaatcggcggtaaagtcaccaaagaagggcgctggaaaccaggttttgtgattacaggccagtcctgggatctgccggtgttaggctatcgtaacggcgtcgcgcaaccgctgcgtttgtggcaggcgacccacgcgcatccgtttgatctgaccaaattcaacgacggcgctttcctgcgggcggaacagcagggtatcgatgcggaaaaactgacgaaggtgctttatcccaacgataaccacacggcgggcaaaaaactgcgcctgatgcagcaatacttccagtgcgcctgctcggtagcggatattctgcgccgccatcatctggccggacgcaagctgcatgagctggcggattatgaggtcattcagctaaatgatacccacccgactattgccatccctgaactgctgcgcgtattgctggatgaacaccagatgagctgggatgacgcctgggctatcaccagcaaaaccttcgcctacaccaaccacaccctgatgccagaagcgctggagtgctgggatgagaggttaatcaaagcgctgttgccgcgtcatatgcagattatcaagcagattaacgatcgctttaaggcgctggtcgataacacctggcctggcgataagcaggtatgggcaaaactggcggtggtgcatgaccgtcaggtgcgcatggccaatatgtgcgtggtcagcggctttgcggtcaacggtgtggcggcgctgcactccgatctggtggtgaaagatctgttcccggaatatcaccagctttggccgaacaaattccacaatgtcaccaacggcattacaccgcgtcgctggattaaacagtgcaatccgcagcttgcggcgttgctggataaaacgctgaaaaaagagtgggctaacgatctcgaccagttgatcaacctcgaaaaatacgctgacgacgccacattccgtcaacaatatcgcgacatcaaacgggcgaacaaagaacggctggtgaaattcatccaggcccgtaccgggattgagatttcgagccatgcgatttttgatattcagatcaaacgcctgcacgagtacaagcgtcagcatctgaatctgttgcatattctggcgctgtacaaagagatccgcgaaaacccgcaggctgaccgcgtaccgcgcgtattcctgtttggcgcgaaggcggcgccgggctattacctggcgaagaacatcatttttgctatcaataaggttgcggaagccattaataacgacccggcggtgggtgacaagctgaaggtggttttcctgccggattactgcgtctcggcggcggaaatgctcattccggcggcggatatttccgagcaaatttctactgccgggaaagaggcgtccggcaccggcaacatgaaactggcgctgaacggggcgttgacagtgggaacgctggacggcgctaacgttgaaatcgctgaaaaggtgggtgaagagaatatctttatctttggccatactgtggaagaggtcaaggcgctcaaagccaaaggctacgatccggtgaaatggcgtaaaaaagacaaagtgctggatgcggtactaaaagagctggaaagcggtcaatacagcgatggcgataaacatgcctttgaccagatgctgcatagcctcggcaaacaggggggcgatccgtacctggtcatggcggacttcgccgcttatgtcgaggcgcaaaagcaggtggatgcgctgtatcgcgaccaggaagcgtggacgcgcgccgcgatcctcaataccgcgcgctgcggtatgttcagttccgatcgctctattcgcgattatcaggcccgtatctggcaggcaaaacgctaagggagcgcgatggaaaataaacgtctcgatagtgccgcgctggcggcggggatcagccccagttacatcaatgctcatggcaaaccgcagtctattggcgctgaaaccaagagacgtttgctggcggcgatgcacggcacgacaacaggaccacaggcggtcgtgccgaatgtgaaggtttataccgcgggtaaaaaaatggcgttgccggtagaggggcgcggtgagtttgcctggctgctgactacggaagagggcgagcattacaaagggcgcgtgacgggcggtaaaaaacttaacctgccggctacgttgccggagggctaccacaccctgacgttgacccaggatgaacagcgtacgcactgccgtattatcgttgccccgccgcgatgctatgagccgcaggcgctgttggaggggaaaaaactgtggggggcctgcgtccagctttatactctgcgttcagaaaaaaactggggtattggcgatttcggcgatttgaagtcgatgctggtcgacgtggcgacacgcggcggcgcgtttatcggcctgaacccgatccacgcgctttatccggcgaatccggagagcgccagtccctacagcccctcgtctcgtcgctggctgaacgtgatatatatcgacgtcaacgccgtcgaagatttccgcctgagcgaagaggcgcaggcatggtggcaaatgcccgccacacagcaaaagctgcgacaggcgcgcgatgcgcaatgggtggattacgctaccgttaccgcgctgaaaatcacggcgctgcggatggcgtggacgcggtttgccgctcgcgacgatgcgcaaatggcggagtttcgtcactttatcgcccgcgaaggcgaaagcctttactggcaggcggcattcgacgcgctgcatgcgtatcaggtgaaagaggatgggcagcgctggggctggccagcctggccggaggcgtaccagtcggtagagtctcccgctgtaaaacaattctgtgaagcgcaccgcgaagaggtggagttttatctctggcttcagtggctggcctggcgccaattcgccgcctgctgggatacctgccagagttttaaactaccgattggtctgtaccgcgatctggcggttggcgtagcggaaggcggcgcggaaacctggtgcgaccgggagctgtactgcctgaaagcatctgtcggcgcgccgccggatatcctcggcccgctcggtcagaactgggggctgccgccgatggacccgcatatcattgtcgcccgggcgtatgagccctttatcgacctgctgcgcgccaatatgcaaaactgcggcgcgttgcgcattgaccatgtcatgtcgttgctgcgcctgtggtggataccgtatgacgaaacagcggatcagggggcttacgtccattatccggtagatgatttgctttctattctggcgctggagagccaacgtcaccgctgtatggtgataggcgaagatctggggacggtgccagttgagattgtcggcaagctgcgcgatagcggggtctattcttataaagtgctgtggtttgaaaatgaccttgagaaaaacttccgcgcgccaggcgcatatccgcaacaatcgatggctgtcgcctcgacgcacgatctccccacgctgcgcggctattgggaatgcggtgacctgacgttgggtaaagctctggggctttatccggatgaagtgattctgcgcgggctgtatgaggatcgcgagcgggcgaaacaggggctattggacgcgctgcataaatatggctgtctgccaaaacgcgccgggcataaggcattgttaatgtcgatgacgccaacgctaaatcgcggacttcagcgctatatcgccgacagtaacagcggtctgttggggcttcagccggaggactggctggatatggccgatccggttaacgtaccgggcaccagcgatcagtataaaaactggcggcggaaattgtctgcatctcttgaggctatgtttgccgatgagggcgtaaacaagctgattaaggatttggataagcgccgaaaagcggccgcgaagaagaagaagtaataaagccggggatttccccggctttatgatggtgagagcacgtaggcctgataagcgcagcgccatcaggcaattctggcgcacattgctgccttatccggcctgcaaaccgcctcgcttaaaccaccatacccagtagcagacagccgatcaggccgcagacggagatgatcgtttccagcatcgaccaggatttaatggtctcgccgatagtcaaattgaaatactctttgaacagccagaagcctgggtcgttgacgtgagagaaaatcacgctcccggaaccgactgcgataaccatcagttcaggactaacgccggtcgtggcgatcagtggcgccgcaatgccgcctgcggtaatcgccgcgacagtcgcagagcccagcgcgatacgcagcaccgccgcgatagaccacgccatcaacagcggagagacattggtttcatgcatcattgaagcgatgtatttatccacgccgctatcgaccagcacctgcttgaacgcgccgccgccgccgatgatcagcagcatcatggcgataattttgatggaagagaccagcgtatcgttaatctgatccattgaacgcccgcggttcaggccaaaggtgaacattgcaatcagtacggcaatcaacgtagccattaccgggtcgcccaggaactcggcaacgggcaggaaagcgtggccttttggcagaatcatctcggcaaccgcacgcatcgccatcagaatcaccggaaccagcgacgtccagacgctgacgccaaagcccggcatctcttcttccgtaaaggttttcgcgctgtacaggccttccgggatcggcttatcgatgcctttcagaaaacgggcgtaaaccggtccggcaaggatcacggtcgggatcgccagaatcgtaccaaacagcagcgttttacccatatcggcatggaaaatcgtggcgatcgcggttggacccgggtgcggcggcaggaagccgtgtgtgacggagagcgccgcggccatcggcacgccgacgtacagtaacgggatattcgccgctgcggcaatggtgaataccagcggcagcatcagaacgaagcccacttcatagaacagagcgaagccgacggtaaagccggttaacactacggcccactgaatatgctttttaccaaatttcgcgatcagggtagtggcgatacgttgagcgccgccgcagtcggcaagcattttgcccagcatggcgccgaaccccataatcagggccagactgccaagcgtaccgccgacaccggctttgatggagccgatgactttatccagcggcattccctgcatcaacccgacagcgagcgctaccaggacaagggcgataaatccgttcattttgaagcggatcatcagaagaagtaacaagataacaccgatagcaacgatgactaatggcatgatttacctggcctttactttgttatgggtaacgtcattgtttcgacgacaaattcctgttgttcccgacgggaacagagtcgcaatagcaccaatactgattaccgttgaaacgaatgagcgtagtcagatgttatatggatgttaggtgcccataagaatgatacgggtaacatatgggtgttgaaaatgaccctggcaggcaaaatttaaattatgagacacaggtcatgttatcggcgaaagaagaagaaccattgttctgagatgtggctgatggcgcagaatggcggcgtagacgccttattcggcctacggtggggcagacaaggcccgacaggcgcaagcgccatcgggcatggatgcggggaaaatcttagtagtatgagtgctcgccgcgctggtgttcggtcagatcgcgaacccctttcagttccgggaattcattcagcaactgtttctcgatcccttctttcagcgtgacgtcaaccatcgagcaaccgttacaaccgccgccaaactgcagaattgcatagccttcatcggtaatttccatcagcgagacgcgaccgccgtggcccgccaactgcgggttaatctgcgattgcagagcatattccacgcgctccatcagcggcgcgtcatcggccactttgcgcatcttcgcgtttggcgctttcaatgtgagttgagaacctagctggtcggtcacgaaatcaatttccgcgtcttccagatagggcgcgctcagctcgtcgacataagcggtcaacaggtcaaatttcagtgcagtatcggtggcttctacggcgtcgggcggacaataagaaacgccgcactctgcgttaggagtgccgggattaatgacaaatacgcggatttgcgtcccttctttctgatttgccagcagtttggcaaagtgcgcttgtgcagcatcggaaatacggatcatagtaatggcctaatagttgactattttagttggttataatacgcccgtcatcgaggctctacaaggttcgacacaggcaccatacctggacagtcgctgcgccgttgcgcaaaagcagttgcgcgatttccgcgacggtacttccggtagtgacgacatcatccacaataaccatatggagaccctgtaccggcaattcaaggcgaaacgcgtttttcaaattgcgcttacgtaacctggcgctgagatgatgttgtgttgcggtcgcccgtacccgcgtgatggtctggctgtcccacgcgcagcccagccagtgcgctaacggttggcataacagatcgctttggttaaatccccgccgccagtgtcggcgcgaccagagcggaacgctgacgattctgtcgggaagcggcaagccagtgctgcggcgcgccataagtacttcctgcaacagtagacgcgccagagcggcggcaatttcgctgcggcgggtaaatttaagctgatgcaccagtaaactcaagggcggcgtatagtcactgacgctcaccagacgctgccagggcggcggtttttgcaggcagcgaccgcaggggagcgaaggatgcccggcaggtaatccgcattgcggacacaggctgacgcgctgacgaacggcgcgcgcgcatacggagcaaatcccccagtggcttaacgccagcggcattcggcatagccagcataatcccggtactgttagcataggtgcatccttgttagacaaaagagaacagtaactgatgaatgacatctggtggcagacctacggcgagggaaattgtcatcttgtgctgctgcacggatggggattgaacgcggaggtgtggcattgcattcgcgaggaactcggctcgcattttacgctgcatctggtcgacttgccgggctatggccgtagttcggggtttggtgccatgacgcttgaagagatgacggcgcaggtagcgaaaaacgcgccggaccaggctatctggcttggctggagtctgggcggcctggtggcgagtcagatggcgctcacccaccctgaacgcgttcaggcgttggtgacagtcgcctcttcgccatgctttagcgcgcgtgaggggtggccgggaataaaaccagaaatcctcggcggattccagcagcagcttagcgacgattttcagcgcacggtggagcgttttctggcgctgcaaacgttagggacggagacggcgcgtcaggatgcccgcaccttaaaaagcgtagtgctggcgcagcctatgccggatgtagaggtgctcaatggcggactggaaatcttaaaaacggtcgatctacgagaagcgcttaaaaatgtgaacatgccgtttttgcgtttgtatggttatctggacggtctggtgccgcgtaaaatcgcgcctttgctcgatacgttatggccgcacagtacatcacagataatggcgaaggcggcccatgcgccgtttatctcgcatccggcggcgttttgtcaggcgctgatgacgctaaaatcatcgctgtaaccagggcgttgccgggcccaggccattctgccagattaatggctttcagacgccagatcggcaggcgccagcccggtaaccctaagcacagtatcgcgatcgaaaccatcgtttagcatggagcgggcaatgcgcaatgcggcgagccgttggcctttctgtttgccttgttgtagccctttctgtaacccgttacgatgtccttcctgacgtaatctttctgcgatagtcatgatcttctccttatgctgtgggatacgcatagccacctggcggataaacgtattgaagcgcgcggcgtcgccagtgtgcatcatgtaattaaacagactttgaagctgggtgtcattagcgtatcccttaaccagcagggcgaccagctgttcgacaagccccatcagatcacgctggcggatgtgtttttgtatgagttccagcagcgcgacccgtcggtgccgcataatctcgtcgtccggcacgaccgtaatatcgaccagaggaaaggcggtggcgtatagcttacgcgccatcaccgggtcggcaaattcatccagccagcataatgagaacggatacgggcttcggtttccgtggtaaaacagcattggcaccactaatggcaacgtcttatgcccggcctccaggtgccgttgcattgcagccattgtgtaacgcatcagccgaaatgccatatgcgcgtccggcgtactctgatgttcaataaccacgtaaatgtaaccgtcaccttcacttgtttccagcgaccaaaggatatcggaataatgggggcgtaaatcctcttcaataaagctaccggactccagccgtaacgtattcagattacagatttgacgtaatgtcgacggaagatggatttccaaaaaatcccgtgcagtatcggggtggcataaaaactgtttgaataccgcgtcatgcggcgtggatgttgttgaggtcgccatatcgatccgtcaccggtgaagctcaatggcgtgacactacgcgcagaccgggctgattgcagtagaggattagtgcgcttgcgaggcgcgtggggagataaatgcgcacggcggtaacgctttcatctttgtggaaggcatgacgcaaaattgcccggcagcgtgacgcgtaccgggcaatataacgcgggataaaggccggataagacgcgttacgtcgctacccggcgaaggtcaacgcaaggcccaccattcgcgcaggcaggctttaccttccggacagcttttacaactgcctgaaaggcaaccgtccggttcttccgggatacgtaccgctttacccatgatctccagttgattcagcatggcgtcgatcatgggctgcggagcgtgcagcgtatggctgatctgcgttgcctccatacgcccccgcagcgccagtagatcgcgaacctgtatcaatgaagccattttttacatcccttagtgacaattgcccgcagtgcccgaacaacaggatgtgacgcttttgcgggttgccagcagttcaatgtctacacggctgcgggcgcggcgtagcagacttaataccacaacgttaaagacgattaccgccagaatacagatcaggctgtaagtcgggtgctgactgaagctagtaacctggtagaacagcgtggcgagcgaataggcgatattcagcccccacaggatggagaagctcatccagccgcggctggactcgcgggcgatagcgcccattaccgagatacacggtacgtaaagcaggacgaaaatcaggtaactgtacgccgccgcggcgctgccgaatttttgatccatcacgcccatcgcgccggtcgtcatttcgccgtcgcctttactcgcttcgatcgggttagccagtacgctcaggctaaaggtgtctttcaggctttgccaggtatcgtcaaccgcgcccagcagttcatcgccgaggtgaaagtcggcaggattaaacgcttcgtcctgaatattttcggcggtgtagagcgtgttcagcgtaccgacgacaacctctttcgccatggcgcccgtaaacagacccacggtagcttgccagttatcctcatggacgccgatcggtttaaagactggcgtgatgacccggcttacagaggcgagggcggagtcattaatgttatcgacgattttgccgctcagcgagaaactgttaaacgcgctcaggaaaatactcacgatgataatgactttaccggcgcgtagtacaaaacctttcaggcgttgccaggtctggatgatcaggctcttgatatgcggtacgtggtaaaccggcagctccatcacaaacggagaggcttcgccacgcataatggtatgtttcagcatcaggccggttaataccgccatgacaatacccagcacgtatagcgagaagaccgccagcgcgccgttttgcccgaagaaggcggcggcaaagacggcgaaaatcgccaggcgcgcgccacaggacataaacggcgccatcatgatggtcatcaggcgttcgcgcggagcgtcaagcgtgcgggcgcccatcacggaaggtacgttacagccgaagccgacaatcagcggcacgaaggatttacccggtagtcccagcgcctgcatcaggcgatccatgacgaaggccgcgcgcgccatataaccggagtcttcaaggaaggagaggaacaggtacatcatcccgatttgcggcaccagcggcaggacggtattgatcccgccgccaagaccttgcgtcaggaagatggttaaccaatccgggaagtgcagcgtgtagccaatccattgaatgccatgaataaagatggcgacggaaccggcatcaaacaggggttgcaacgcgccgccgatgttaatggcgagcaggaacatcaggtacatcacgaacaaaaaaatcggtaagccgaggaagcggttcaggataattttatcgaccgccctggtgaagcggctgggttcggctgtcagggtattgctgaccacgtcgcaaatagcggcgatacactggtaacgggcgtcggcgatatgcagcgccgggtcgtccatttcgtccttcagacgggcaagggaggtgtccaggttttgcgccgtctcgcctgcgtaagcccggctgtagatatcgccctccagcatttgcagacccagccagcggcgctgttgtaaaggcatctcctgggccatcgcgtcggccaggaaacccgcttcgcgcagcagcggctgggcataatgcaccagttcgacgttgtcgttagcgttgtgacgatcaatggccagtttcagcgcctcgataccgcgaccgcgagtcgataccagcggtacgacagggcaacccagacgcgtggacagagcgtcgacatcaatacgaacctgctgtttttcggcgatatccagcatgttgagcgcgacaatacaggggatacccagctccagcagctgcagcgtcaaatagaggttgcgctccagattggaggcgtccacaacgtttatcaacaggtcggcgtcgccgctcaggatgtagtggcaggcgatctgttcgtcgagagaggtttgtgacgagatggtcgtcagagaataggtgccgggtaaatctaccagcgtgacctggtggtcagttgtcgcgaactggccctctttacgctcgacggtgacgtccgcccagttccccacgcgctgacgcgcgccggtgagttggttaaataaggtggtcttgccggaattaggattaccaattaaaccaatggttaattttttcatttttatagactcactgtattaacaggaaaccgcttccacttctattaacgccaaatcctttttacgcaaaaccagactcacgcgtcgtgtttcgatatggatcggatcccctaagggcgcgacgcggacaacattaaatgaagagccgggcaacatgccgagcgaaagcagtttttgacgatacgccgggctgatttcacgcgcaaagccggtgattttccacgcagtgtcaggagtgaattgcatacgacctacttgtttcttactaactggatgtatacctcatgcggcgctcaggggggcggcaggagacccgatgtttagccaacgaaggaaagagtaaataatcaacaacacaatgataatgagaatggtttctatcttcaacgattaaaatgtgacggaatgtacaaataagcgataatttgcgccgatgttgatatggctcaacatttatttgtctttttgcaaatacctctaatgtgcaaatattcaccgtttttaatgtttaattaaggtttcatctgttaataaagtgataattaatagtgcggatagcagaaggaaattaattaacagattctaatgggtaagatttaattgttaattaaaaaagaaagggttggacgtattgcaaaatcgcaggccggataagaagtaacccggcctgcgtattacccgattagcgtttttttcccattgccgctgccagcgcgtccatcatggcgctgttaccggctggctgggcgtcacgaccgcgcggtttcgccgcttttgacgccgggcggttgccctgagcgcgatcggcaccgccgccgcggcgagcggcggtttcgccgggctgttcgtccagacgcatcgtcagcgcaatacgcttacgttgcagatccacttccagcactttcaccttcacgatgtcgccagcttttaccacggtgtgtggatcgtcgacgaacttagtcgacagggaagagatgtggaccaggccatcctgatgaacgccgatatcgacaaacgcgccgaagttagtgacgttagtgactgccccttccagaatcatccccggcagcaggtcgttcatggtttcgacgccatcggcgaattgcgcggttttaaattcaggacgcgggtcgcggcccggtttttccagctctttgatgatatcgttcacggtcggcacgccgaatttatcgtcggtaaaatcagcggccttgaggtgacgcaattcgttgctgttgcccatcagatcttttagcgcttgctgcgtcgccgccagaatgcgttcgacaaccggataggcttccgggtggacggtggaggcatccagcgggttatcgccgtggttaatacgcaggaagcccgcgcactgctcaaacgctttcggccccagacggctcaccttcaacagttgctggcggttctggaactgaccgttctcatcgcgccaggcgacgatgttttgcgccatcatgcgcgttaagcctgcgacgcgggtcagcagcggtacggaggcggtattcaaatcgacgccgacggcgtttacgcagtcttcgaccaccgcatccagtttacgggccaattgggtctggctgacatcgtgttgatattggccgacgccgatcgatttcggatcgattttcaccagttccgccagcggatcctgcagacgacgcgcgatagagaccgcgccgcgcagggagacgtcgagatccggaaactcctgcgccgccagctcagaagcggaatacacggacgcccccgcttcgctgacgatcactttctgcgccgtcacgttcgggaactgtttctgtacgtcgagatagaaacgttcggtttcacgcgaagccgtaccgttgccaatcgcgaccagttcgacgtggtatttttcgcacagcgcggcgatcacggtagccgctttggccgcctgaccggtatgcggataaatggtatccgtcgccaccagcttgccggtgccgtcaacgacagcgacttttacgccggtacgcaggccaggatcaaggcccatcgtggcgcgcaggcctgcgggggctgccatcagcaggtcgtgcaggttacgcgcaaacacgttaatcgcttcgtcttccgcacgttcgcgcacggtgcccatcagttcggtttcgaggtgcattaagactttgatacgccacgtccagctcactacgcctttgcgccagctatccgccggggcgttatttagccgcaggccgagatggtccatgatgatttgctcgcagtagctctctttcggcggctcatcaaactgtgggtcggcattgagcgaaagttgcagaatgccttcgttacgaccacggaacatggccagcgcacggtgagacgggacgttagcaatgggctcatgatggtcgaaatagtcgcggaattttgccccttcttcctctttgccgctcacgactgtggcgaccagatgggcattcttccacaggtaatcacgcactttcgccagcaatgcggcgtcttcggcaaagcgctccatcagaatgtagcgtgcgccgtcgagcgcggctttcgtgtccgccacgcctttgtcgccatcaatgtactttgccgctttcacgtcaggatcgtgggacggttcgttccagagcagatcggccagcggctcaaggccggcttcaatggcgatttgtccacgggtgcggcgtttaggtttatagggcaggtagaggtcttcgagctcggtcttacttaacgtagcgttgatggcgccagccagctcatcggtcagtttgccttgttcggaaatggacttgaggatggcctgacgcctgtcttccagctcacgcagatagcccagacgcgtttccaggttacgcaactgcgtgtcatccagaccgccggtgatttctttacgataacgtgcgataaacggcacggtgttcccttcgtcaagcaggcgaacggcagcttcaacctgcccggcatttgcctggatttcacccgcaataatgcggcagaaagaatcattcatcatgggttagcttcgtcttcaggataaaaatcaggggatagttatacggattggctggcaaaaatgccagccatcagcgggggcttaggattcttcttgtcttatttgacgtattcgatcgcattgacgtaccagtttgcttcgccgacaggggtgttgaccaccgccagatcgcccacttcttttttcagtagcgcccgcgccatcggcgagtcgatagagatgtaatccttacgtccgaaaatttcatcgtagccgacaatgcggaacttcagcgtatcgccgtcatcattttcgatttccacccaggcgccgaagaagactttgccctcctgctgcggggaataatccacgattttgagattttccatgcatttggtcagatatctgacgcgtctgtcgatctcacgcaggcgctttttattatactgatagtcggcattctcgctgcggtcgcccagactcgcagcccaggtcacttttttggtgacctccgggcgctcttcacgccagagataattgagctcttgtttgagtgtttcgtacccttcgcgggtgatcaggggcgttttcatctcgttgatttacctttgctgtcgatattgcgcacacggggtataacgtgatcgtcccgacagaataaataatggggttgccgattaattgtatatttaagctgctgttaaatatgctttgtaacaatttagcctgaaattcataccagaatttgctggtgactcacgtgagcttttttaagaatacacacttacatttgttgcgaacctttgggagtacagacaatgcaagagaattataagattctggtggttgatgacgatatgcgtctgcgggcgctactggaacgttatctgaccgagcagggcttccaggttcgaagcgtcgctaacgccgagcagatggatcgtctgctgacccgtgaatctttccatctcatggtactggatttaatgctgccaggtgaagatggtctgtcgatttgtcgtcgcctgcgtagtcaaagtaatccaatgccgatcattatggtcacggcgaagggtgaagaggttgaccgtatcgtcgggctggaaatcggcgccgatgactacattcctaaatcgtttaacccgcgcgagctgttggcgcgtatccgcgccgtgctacgtcgtcaggcaaacgaactgcccggcgcgccgtcgcaggaagaggccgttatcgcgttcggtaagttcaaactgaacctcggtacgcgcgagatgttccgtgaagatgaaccgatgccgctgaccagcggggagtttgcggtactgaaagcgttagtcagccatccgcgcgagccgctctctcgcgacaagctgatgaatctggcccgtggccgcgagtattccgcgatggaacgctccatcgacgtccagatctcccgcctgcgccgtatggtggaagaagatccggcgcatccgcgttatattcagaccgtatggggcctgggctacgtcttcgtaccggacggttctaaagcatgaggcgaatgcgcttctcgccgcgaagttcatttgcccgcacgctgttgctcatcgtcaccttgctgttcgtcagcctggtgacgacctacctggtggtgctgaacttcgcgattttgccgagcctccagcagtttaataaggttctggcttacgaagtccgtatgctgatgaccgataagctgcaactggaggacggcacgcagttagtcgtgccgcctgcgtttcgccgggaaatctatcgcgagctggggatctctctctacaccaacgaagccgctgaagaggccgggctgcgttgggcgcaacactacgaattcttaagccaccagatggcgcagcaattaggcggcccgacggaagtgcgggttgaggtcaacaaaagctcgcccgtcgtgtggctcaaaacctggctgtcgcccaatatctgggtgcgcgtgccgctgaccgagattcatcagggcgatttttctccgcttttccgttacacgctggcgatcatgctcctggcgataggcggcgcgtggctgtttattcgtatacagaacagaccgttagtggatcttgaacatgccgccttgcaggtagggaagggaattattccgccgccgctgcgtgaatatggcgcctctgaggtgcgctctgtgacccgggcgtttaaccatatggcagccggcgtgaaacaattggccgatgaccgtacgctattgatggcgggcgtcagccacgacttacgcacgccgctgacccgtattcgtctggcgacggagatgatgggcgaggaagacggttatctcgcggagtcgatcaataaagacatcgaagagtgtaacgccattatcgaacagtttattgactatctgcgtaccggtcaggaaatgccaatggagatggcggatctcaattccgtgctgggcgaggtgattgcggcggaaagcggctatgagcgtgagattaacactgcgcttcaggcaggcagcatccaggtgaaaatgcacccgctctcgattaagcgcgcggtggcgaatatggtggtcaatgctgcccgctatggcaactgctggattaaggtcagcagcggcaccgagtcgcatcgcgcctggttccaggtagaagatgacgggccgggcattaagccggagcagcgtaaacatctgttccagccttttgtgcgcggcgacagcgcccgtagcaccagcggcacagggctggggctggcgattgtgcagcgcattattgataaccataacgggatgctggagattggcaccagcgagcgtggcggattgtcgattcgcgcctggctaccggttcctgtggctcgcgtccaggggacgacaaaagaggcataagaaagggaggtattaccctccctttcttcttaacactggatgacgctgttcaaagccgccatccggcctgttccttacagcttcggtccggcgctaaccagcgcttcgcctgccggggtatccgtatacttctcgaagttctcaatgaacagtttcgccagcgcggtggctttttcctgccattgttccggcgacgcgtaggtgttacgtgggtcgagaatgtgggtatccacgcctggcagttcagtcgggatcgccagatcgaacagcggcaggcggaaggtttccgcgttatcaagagaaccgttcagaatagcgtcaataatcgcgcgcgtatctttgatggagatacgtttgccggtgccattccagccggtgttaaccagataagcctgtgcgcctgctgcctgcatacgtttcaccagcacctcagcatactgcgtcgggtgcagcgtcaggaacgcggcgccgaagcaggcggagaaggtgggggtcggttcggtgacgccgcgttcggtgccggccagtttagcggtgaaacccgacaggaagtggtactgcgtctggttagcggttaaacgggaaaccggcggcaacacgccgaaagcatccgccgtcaggaagataaccttggtggcgtgacctgctttggatacgggcttaacgatgttatcgatatgatagatcgggtaagagacgcgggtgttttcggttttggaaccatcgtcgaaatctacggtgccgtcttcgcgcacggtgacgttttccagtagcgcatcacggcgaatcgcatgataaatttctggctccgcttctttcgacagtttgatggttttggcgtagcagccgccttcaaagttgaacacgccgtcgtcatcccaaccgtgctcatcatcgccaatcagacgacgtttcgggtcggtggacagagtggtttttccggtaccggaaaggccgaagaagaccgcgacatcgcctttttcacccacgttggcggaacagtgcattgaggcgatacctttgagcggcagcaggtagttcattaccgagaacatcccttttttcatttcgccgccgtaccaggtgccgccaataagctgaatacgttcagtcaggttgaacgccacgaagttttccgagttcagcccttgctctttccactgcgggttggtgcacttcgcgccgttcatgacaataaagtcaggtttgaagcctaccagctcttcgtccgttgggcgaatgaacatatttttaacgaagtgggcctgccaggcgacttccgtaataaagcgcacggaaagacgcgtatcggcatttgcgccgcagaacgcatcaacaatgaataagcgtttaccggaaagctgatgcgtcaccagacctttcaggtgttgccaggtttcctgggaaagcggcttattatcgtttttacctttacccttatcggaccaccacagcgtatcacgcgtggtgtcgtcgcgaacaatatacttatccttaggcgaacgaccggtaaaaataccggtatcaacggcaacagcgcccaggttagttaacacgccacgctcatagccttccagaccaggattaagttcttcctgataaagggtgtcgtagctgggattgtaaacgatatcctggacgtcgttgataccataagccttgagatcttgcggggttaaattgttaacgcgcatatcactgctccttagccaatatatattaccgaaaatagtaaggttttttgaggttggttaaccgcgacaaggctcatagatttacgtatctggacaaaatcacgattgacgaaaaacactgtgactcctgtcacgcagcggcggttattatggcaggaaacctacttttgttgtggaaaatgttctgaaaacgttaaaaggaagtgtttttgaccgacataatgtgactgtaatcgcattcatgtaagaaagttacgtaacaccaacattaacaatatcgattcacctctctgcgtttttttctgaattatgcatgacgacgcctggcggtgaacagatggtgcaataatgcggctttctcatcattctggataacgacatggaaagtgtagcgctttcacgtactactcgctggggtatgttgctcactggtttgctgcagggcgtcttgtgctacctgctgatggcctggctggtaccacaaaatagcgactggctgttctatggtatgcctgcgacgatagcgttgtcgtcaatgctattgcttaccgtggtctcttttaaacagcgcgcgctgtggggctggctggggctgatctttgtggtcgtgctggcaatgagcggctggctgaaatggcaggttgaggcggtggagaaatggcgcctggccgagctcctctggctgtatggtcttcggcttgtgttgatggcgatgctggtattaccctggatgcaatatcagttacattcgcaaaccggttcggcgcgttatccccagttttatctgcggttatggcataacgtactgacattgtttatcgtcctggtcgccaacggactgttctggctggtgcttctgctctggagcgcgctattcaggctggtgggcatccgctttttcagcacccttttctttgaaactgaagcctttatttatgtgaccatcggcctgattacggcgctggcggtcattctcgcccgcacgcagtcgcgccttgtggcggcggtgcaaaagctgctgacgctgatcgcgacgggtttactgccagtggtgtcgctgctggcattgctgtttattgtgacgttaccctttaccggactggaggcgatttctgcgcgtgtttccgctacggggctgctatccacgctgacgctgatgctgctgctcctcgtggcgattgtcaacgaaccgcaaaagcgcgtattaccctatccgcgcgtactacgcggcatgattagcgcctcgctgtgcgttgccccgatatatatgctgctggcgggctgggcgttatgggtacgcattcagcaatacggctggacgccggatcgtctgtatggcgcgctgacggcgtctgtcttgctggtatggtccttcggttatctgatcggtctgttacgccgcggacgcgaccctgatgagtggcaaggcaaggtgatactgagcgtctctttgttgacgctggtgatattgctgttgctggcctcgcctgtacttgatgtctggcgtattagcgtcaacagccatatggcgcgttaccatagcggtaaaattactgcggatcagatcagcctgtatatgctggatcacagcggcaaacctggccaggaagcgctgaaatcgttgcgggatgacgaggcgtttacgcagaacagaaagcgcaatcgtgaactgatgacgtttttgcagagaaataaggtccctccgacggcggacgatttagcgcgggtggtgatgattgcgcccggtagccagaagccggatgccgcattttgggcgtttgtcaaagagcagagttattcggacgcttcctgccttgaaccggatgcctgcgtgctggtgagtcaggatcttaacggcgacggtcagcctgagcaggtgctgtataactttattgttgccgagagccaggtctacggcttaaaagaggggaaatggacgcagaaagcgttcgcccgattgccggacgggttttctaagacgcaactgttgcacgcgattgccgggcatcggttagactcagcccccaaagcctggcgcgatatcattgttgatggtcagcggttggatgtggattactacaacgagtaagctttttgccggatggcggcataaatgccttatccagcctacggagcgggatgctgtaggccagataagcgtagcgccatcaggcaatgacgctgccgactacgaggcgattaatgaacctgtggatcggcaggagaggcgttgttacggatctccgcgatatccatcgcattgaacaggtaatgattgccgcagtaatcgcagtgcatatcgatttcgccttcttccgccagaatgctgtccacttcttcatccggcaatgttttcagcgcgcccgcgcaacgttcgcgtgaacaggtgcatttgaattcaacctcttgcggatcgtagagcgtgacttcttcttcgtgatacaaacgccacagcacgtcatttgccggtaatgtcagcagctcttcgcttttaatggtttccgtcaacatggccagatggtcgaaatcctccgcctgcgcgttctgtgccggcatcacctggagcaacattccacctgccgccggtttaccgtcgacatcgccggtacggataaacaggcgcgtcggcaactgctcggagcgcaggaagtaatcttccaggcacgccgccagagtatcgccttccagacccaccacgccctgatagcgttcaccctcttccggcgtaatggtgatcaccagatagccgttgccaaccagcgttttgagatccgcattgtcagggatatcgccctgaacgcgagccacgccgcgcatctgctgctgattattgccattgatcaccgccaggcttaacggcccgtcgccctggagctgtaccgtaatgtcaccggcaaacttcagcgtcgcggtcagcaggctagtggcgaccagcagttcggccagtacggttttcaccgactgcggatagttatgattgtcgaggatctgttgcaaggtttccgaaacggtcaccagctcgccgcgaacggcaaagttttcaaacagataacgatgtaattggtcatgttgcggcataatcatctttcttgcgggtgacagttattcgctgtcgccgtgtttaaatcgtaacaggtcgcggtgctctttcttgtccggtcgcctggccggatgcggcatggtcagggcgttaagcttgcgcgcctgcgccattttttcgcgtttttccacgctttccgccgtctcttcatacagagcgacggcttcgctggccggacggcgctgttcggtgatggctttaacgatcaccgtccgttcgtcatttccctgacgcagggtaagggttgcgttcagctcgacgattttgctcggcttactgcgctggccgttgtaatgcaccttaccgccttcaatcatctcgcgggccagcgcgcgggttttataaaaacgcgcggcccacagccatttatccagtctgacctcaacggaggacttttctttcatggcgtctccttcacttcagcgaggggatcagacggcggtagtcgttcagggacggatggcgcgtatagtgcttttccgccagaccggaatcgggattcgtcacgccaagacagtagcgaataccaaaccgggcggcggcgtcgagaatcggttcgctgtcatcgataaacagcgttttctctgcgcttattcccgtttcctcagtgacagcgcgccataaccgctgatcctctttgggataaccaaatgtgtgggtggaaagtaataaatcaaggtgtgaggccagaccggtatgctccagcttcaccgccaggttatgtggatgcgcattggtgagcagaatccgacgttttccgctggcttttaacgcattcagaaacggtacggtatcgtcgcgcaaaacggcgcgcggcccttgcgccgtcgtcatggcgcaaatatccagacccagacgctcgctccagtaatccagacagtaccagtttagcgtatgctgtacggcatgatactgctggcgaatatattcctgcgcgtcttgcggcgaaataccctgctgcgcgccgtaggtttccggtaccagcttttgccagaaatagttatcgaacgcgagatcgagcagcgtgccgtccatatccagcaaaacggtatccacgttttgccagtcaatatcaatatgcatggggaactccagggtaacgcaatttgcgcgacagggtagcataccctgtcgcacggcggcgctatcagatgagattttccggagagacggttaacctgggattgaggcagctttcatagtattcctggatgtccgccatacgggtatggtggcgttgataacgcctgaacgcctgaatgccgttgtagaccgcgctcactatcattgccagcatcagcagcgtggtgccgaggtaacgccaccagccggatttatcggggatacgatgcaggctgatatgctgcgtgccgttggcatcggtatacacgctggtgacaatgccctcggcgctaaatggcgtctgcatgagcgtttgcgccagacgctggaaggcgctccactgttcctgcgcgggatagtcatacagcggcgttgacggccaggcctgatcaaccagttcgctgccttcatcgctggcgatcaggaatccgccgggagcggggctattcagcgactgggcggcacgcgcggtctcgcgagaaataaacggcgccgttgaggtcgtgaccagattttccagcgactctgcgcttacggggcgtagcagcacgttgacgccgtccagtttgccggcgttcgcgcgtttcaccagcgcgttccagtccttactgttaccgagattaaccagcgcatttttcaggcgcacgcactcgtcttccgccgcgcacaaatcagcggttttcagaacaatatcgccaaagtcatctaataataccatgcccgatttttggatcgcggagcgtaaagatgcgcttacgcgcgagtcgtcttcgggttttggatggagctgacgatttaccgcctggcttagcgccatcgctttattcaccagatctgattccggcagcggtagcgcaggcgcgtcattccagatgatttgcgagcaatcgaacggcataaacggtgagttagactgcccgctccaggtcgccccggaatgaatattacacattcctttaccgctcaggtgcagcgtatcgcccacccgtacgccagccttttcaagctgttttaccgttgtcgcttcaatggtttgcgcgcctttcatccacgatagcgtgaacttgattggcatatccaacgggatccagaacagcagcataaacaacaccagcagcgaaccgatagcaataacagtgctgcgtaaccagtgctgcaacgggaagtttttcacttcatcatgcagggataaaaaacggccctggcgggcgacatggcgatcaaggtaaatatcaatatccgtttgttgcccaagatcctgcgtaatgtaaggttgccagtgggcagggtaaataaggtcgatgatgcccagggaaatattgttaatctgctcctgattattctccccaaacagtccccagcggcggggcgttccccgcagacagtgaatttcccgcagcgcgcttttcgacggcggcgcaaaaagcccccaaagtccggctgccagcagcaggatcgcgccgcctatcatccacggtacaaaaacgtctggcgttatcagacagaaaaagaataacaaaaaggaggcgacgattaacaatgcttcgcgcaagccagccgggcggctgagcgcatattcttcgtgggtctcctgacggatgttcaacagctcaatctgctcgctctcttcgccgcgaatcgacgcctgcgtagaggccgtattctgtagcgcgtagccgcgcgactcctgcatatactcttgcagcgtatggccgtttaaagagatcaccagcggcagcgtatccgtgaggattagctcaacgttgttttcatcattgatgtactgttcccagaaaggcggcagatggacttcgacggagtcgaggtagtagcgccatttattaggatcgtcagtggtaatgccgtagcgggtgatggagtgggtcagtatcacgacactgttgctttccgcgttcagcgtcagcgagatgggcgcagcactggcgcctgtcggccccggaacttgctggatctggctaaggttatcgagatagttttctaccgcgctgcgctcttcgggcaacagtttacgcgtttgcgcgtcctgaaaggcgctgaaccacggtaagctccctcgtctggactttactcggaaccgccatattgccagtagagagcaggccagcaaagcagctataaaaatcagaatggtgctcatgctttccccatcttactaagtctgtcaggcgtggtcagtcgcaccctgtccaataaacatttttctgtggttggctatcggcaagcgtggagttgaacttgagcattgtaaagcgcatcccagtgaaggcaaatcatagcaataccaccaaaaacggaatatcagcaaattcctggagttatttcaacctattgacttttaatttgaaataagaattaatttttattacgttacataaatgtaaataaacggcaattcgcattgccgaaaccgtgcggtatgtcgcacaatgaccacagattacactgcaaagattctcacaatgagcaaatcattacaaaaacccaccattctgaaagtggaaaccgtcgcacaatcccgactgtttaacgtagaaagcgtggatctggagttcagcaacggcgtgcgtcgcgtgtatgaacgtatgcgaccatcaacccgtgaggcggtaatgattgtgccgatcgttgatgagcatctgattcttattcgtgagtatgcggtgggaaccgaatcctatgagctgggcttctcgaaaggattgatcgacccgggcgagaccgtttttgaagcggcgaaccgggagctcaaagaagaggtcgggtttggcgcgcataacctgaccttcttaaaaaaactcagcatggcgccctcttatttttccagcaaaatgaatatcgtggtggcggaagatctctatccggagtcgctggaaggcgacgagcctgagccattgccgcaggtacgctggccgctggcgcatttaatggatctgctggaagaccccgattttaacgaggcccgcaacgtcagcgcgctgtttctggtacgcgagtggttgaaagcgcagggccgaattgcctgatggcgcggcgttgatcaagccaacggaaagtttgtctccccgttcgccgtcatccgctaaacacaataaaaaaggcgccggagcgccttttttgatcagaacagttcgtgtgtttcaccattatcaataatggtggttcccacctcgtgtaccgcctgttgtgtcggctgcgtgccttcgatgaaatactcttcacggctgttaccgccgctcgccagttgtccggtactgcggtcgatattcaccgtgacgatgcccggcggcggcgttagcggctgtttcggcacgccttccagcacggctttcatataggcgtcccatgcaggttgcgcgctcttcgcgccgccctcatagccggagatttgatctttgatcgcgccggaagcggtggtgcggcctaaatcacggcggtgatcgtcaaagccgatccatacggaagtgacgacgccaggaccatagccggagaaccatgcgtctttcgagctgttggtcgtaccggttttgccgccgatatcgcgacgtttaaggtcgcgcgccgcacgccagccggtacccatccagccgggttcgccgaagatattggtgttcagcgcgcttttgatcagaaacgccagcggcgtattgatcacatgcggcgcgtactcctgcgtgccgttttgcgcgaccagcgcctggtttgcctgttccagctcaggcatcggtacggcgctgttttgctgctcttgcgaaaccgcgacctcttccacattggtgttttccagcacgtcggatttctgcgtattgccgtaaatgaccgggatatcgcactccgtgcaggcgattttcggtttcgcttcgaagatcacgccgccctgatcgttctcaatcttgctgatgaaatacgggtcgatcaggaaaccgccgttcgccatcaccgcataaccgcgcgcaacctgcatcggcgtgaaggaggtggagcccagcgccagcgattcggtatgcacgatattctgcgccgggaagccgaagcgttgcagatactccgccgcatagtcgacgcccatggcgcgcatggcgcgtaccatcaccacgtttttcgactgccccagcccctggcgtaaacgaatcggtccggcgtactgcggcggagagtttttcggacgccagtctgaaccggccccggcgtcccagcgggaaatcggcacatcgttgagcatactggcgagcgtcaggcctttatccattgcggcggtgtagaggaacggtttgatgttcgaccccacctgacgcaaagcttgcgtcgcgcggttaaatttactctgattaaaatcgaaaccgccgaccagcgccagtaccgcgccagtttgcgggttaagcgaaaccagcgcggagttcacttccggtacctgcgccagccaccagtcgttatccacctgacgaacccagatttgctgacctgtctggacgacatcggtaactttacgcggcgtcggcccctgctgtgtatccgagcggtaaggccgcgcccaacgcattccttccatatgtagcgaaacggacgtaccgtcggcaagcgcagcggtcgcctcttgcggattagcgctggtgaccacggcgggaagcagcggtccgtaggtcggcaacgctttcaacgtatcggtaatttttttactgtcccacgccgtttcgcccactttccatagcacattcgccgggccgctataaccgtggcgcatgtcatagtccagcacgttattacgcaccgcctgttgcgcggcctgctgcactttgcgggtgatggtcgtgtaaatacgataaccatcttcataggcgctttcgccataacggttatacatttcctggcgcaccatttccgacagataaggcgcggagaaggcgatttccggcgcgtgataatttgcgtcgataggttcgctacgggcctgatcgtactgcgcctgagtgatatatccctcgcttaacattcgtgagagcactacgttacggcgcgccaccgcccgatccatcgagtagagcgggttaaaggtagaaggcgctttaggtagcccggcgataaccgccatttcgcttaaactaagctggtcgaccgtcttaccaaagtagacctgtgccgccgcgccaacgccataggcgcggtagccgagatagatcttgttcagatagagttcgaggatctcatttttattcagcaactgctcaatacgaatcgccagaaacgcttccttgatcttgcgcatcagcgtgcgttcggggctaaggaagaagtttcgcgccagttgctgggtaatggtacttgctccctgcgatgcgtgaccggagaagagcgcgacgctggccgcacggaaaatacctaccgggtcaataccgtgatgctcataaaagcggctatcttcggtggcgataaaggcgttgatcatttccggcggaatttgatcgagcgtaacgggaatacggcgtttttcgccatattgcgcgataagttcgccatccgcgctgtaaacctgcatcggaatttgtaaacgcacatctttcaatgtcgcgacgtcaggtagctgcggctcaatatagcgataaaggtcataaatcgagcctgctcccagcaggatgcaacatactgcaaggatcaataaatactttacgaacttcactggagatttcccatttagtgtcatttgggcagtttataaacaaacgcgcggtagtataaaggcaagccagacgcattgatatacccgttaacgcgacgggtgataaggagatcgaccgttatggcttttaaaacctggcaaataggattgcatattcagcagcatgaagcgctggccatcgccgttattcgcggcgcatcgggctggtccctgcaacgttggtggcgactgccgctgatgaacgcctccacggcagagggtacgattcctgacccgcaatcgctggctcacgtactgcgaccctggagccgcgagctgccgctacgtcaccgtatttatctctcttttcccgcaaatcggacattgcaacgcgcttttccacatccgccgatgcgtctgcgggaacgtgagcaagtcgcatggctttcacaaacgatggcgcgtgagctggatatggatccggacttattgcgtttcgactttcaggacgatgcgctgagccccgcgttcaacgttaccgccgtgcaaagcaaagaaatttcagagctgttaacgctggcgcaaacgctcaatgtacgcatcgctgctgtaacgcccgatgcctgcgcgttacagcgcttgctgccgtttataccttcggggcggcaatgtctggtctggcgcgatgaaagccagtggctgtgggcgacgcgctatgcgtgggggcgtaaatcggcgcgagaggcgatgacgctgcatgaccttgccgcgacgttatccgtcgtgccggaacatatttcgttatgcgccgaaggcgaattcgacccctggcgcgccgttaccgtccgccaaccgccggttccgccggacggttatcgctttgcgattgcgctgggtttagccatgggggagatacgctgatggcgcattctgtcaatttgcttccctggcggcgccaacattatgtagcgcgtctgcggctgtggtgcgtggtatggggcgcgtccctgctgctgatagcaagcctcgcgacgatcgcccggttggttttttggcaggaggggaggattaatgaactgctactgacggcggaaaacggacgcacgacggcgcttgcggcgaacataccgcagttgcagcagcgtcagcgacagcaacaggcgcgattacaacgtcaggcgcagcgtgaactgacgcaagcctggcaatctatcttgactgaccttgccaacctgttgccagagcaggcatggctgacaagcctcaattatcagcaagagacgctagagctggaagggctggcgagaacgtttgacgccctgctcacgcttgagacatcacttcgtcactatgtcagttttccgctaaaccgcacgggcgccacgcggcaggatgcgcaagggcgctggcagttccattatcagttaacgaggagcgccgcccgtgaacgcgctctttgatatctggtacgggatgtcgcgccgtggtcgggttttttgttggtgtgcaggcgtgctgtgcctgacgctgacggtcgcgttatctgtgggctatcccggctggaagacgctggatacgcaacatgcgcggttaagccagcagcgcgaggccgcccggcaacagtggcgtcatctgcgccgtctgagcgtcgcggctgaaccgcttttcgggcgtaccatcgaaaatccgcgtcctttttcgccgttagatttccaggcgcctcccttgcgtttgctgcactggcagccatcggcgcaggggggagaaatggcgctgaaaacgtcctgggatgcggtgccgtcgctgtttgtccggttggccgaaagcgagatgagcgtaagtcggttttcattgcgtagggagggggcggaattattgataacgctgcaactggagcgactggcgaatgaaggttagccgcggtgtattgctctgtttttgtttgctgacgttgacgggaatgcgcgatcccttccgcccgccggaagatcgctgccggatagcggaactctcgcagtggcgatatcagggcgcggtgcgtaaaggcgagcgatggacaggcattcttaaagacagccagcaaaaatggcggcgagtggaagaagggcagacgctggaaaacggttggacgattgtccgcctgacggcggaagccttaacgttaacgaccggtaaaaattgtgcgccgccgcagtggcggtggttacgtcagggagcggacaatgaagcgatggatagccataatactgatagtcttgatgcccgccgcgcaggcgggaaaagcggcgaaagtgacgctggtggttgatgacgttcctgtggtgcaggttttgcaggctttagccgaacaggagcggcagaatctggtggtgtcgccggacgtcagcgggacattatcgctacatctgacggatgtgccgtggaaacaggcgcttcagacggtggtcaatagcgcggggctggtgctgcgtcaggaggggaatattctccatgttcattcacaggcctggcagaaagaacacagtgcgcggcaggatgccgagcggttaaggcttcaggctaatttaccgctggaaaaccgcagcattagcctgcaatacgccgatgccggcgaactggcgaaagcgggcgagaaactcctgagcgcgaagggaaccatcatggtagataagcgcaccaaccgcctgctgttgcgcgataaccgcgcggccctggcggagctggaaaaatgggtatcgcaaatggatctgccggtggcgcaggtggagctggcggcgcatatcgtcaccattaacgaaaagagtctacgggaactgggcgtaaagtggacgctggctgacgcgacgcaagcgggcgcggtgggtgacgtgacgacgctttccagtgatttatccgtcgccgccgccacctcacgcgtcgggtttaacatcgggcgcattaacggacgcctgctggatttagagctgtcagcgctggaacaaaagcagcagttggatattatcgccagcccccggctgctggcttcgcatctacagccagccagtatcaagcaaggcagcgaaattccttatcaggtttccagcggcgaaagcggcgcgacctccgtggaatttaaagaagcggtactgggaatggaggtgacgcccaccgttttgcaaaaagggcgcatccgcctgaagttacatatcagccagaatgttcccggtcaggtactacaacaggctgacggcgaagtgctggcgatagataaacaggaaattgaaacgcaggtagaggtaaaaagcggcgagacgctggcgctgggcggcattttttcgcgaaaaaataaatcgggtagcgatagcgtgccgctgttgggggatattccctggcttggtcagctcttccgccatgacggcaaagaggacgagcgacgcgaattagtggtgtttatcacccccagactggtggcgacagaataatttatgcataaaaaagcgctgtttttgcactgaacgcatctgcgggatttgacgtgcggatgtatttagcatacaaggagtaccgatttgagagtcgtgcttttcgttgcttacgcattgattaatgcgctttgccttgccgaaggtgtgcataagaccgatgataaacggctgaatgtccgctgatgcagacgtattggttctgcggattgcgcacaattgtttgaaagtagagcaatttgtaggccggatatgttgttctggtcgccatttggcaacgctaactcgggttttgcaacaatcaggcttggtgatttattcagttgccaaacccgcttgagtattgagataattttcagtctgactctcgcaatatcttatgaggtttcagttcatgtcctgctgcgctgggtgtctgtgaagcgggtttaccattaacgaatagtcttagtagtaccgaaaaaatggcagagaaacgcaatatctttctggttgggcctatgggtgccggaaaaagcactattgggcgccagttagctcaacaactcaatatggaattttacgattctgatcaagagattgagaaacgaaccggagctgatgtgggctgggtcttcgatgttgaaggtgaagacggcttccgtaatcgtgaagaaaaagttatcaacgaattgacggaaaaacagggtattgtgctggcaaccggcggtggctctgtaaaatcgcgtgaaacgcgtaaccgtctctccgcgcgtggcgtcgtggtctaccttgaaacgaccatcgaaaaacaactggcgcgcacgcagcgtgataaaaaacgcccgctgttgcaggttgaagcaccgcctcgcgaagttctggaagcgctggctaacgaacgcaatccgctgtacgaagagattgccgacgtcaccattcgcaccgacgatcaaagcgctaaggttgtggcaaaccagattattcatatgctggaaagcaactaattcaagcagaatacgctgggtaagcgggcacaagtaactaaggtggatgtcgcgtcatggagaggattacagtcactctcggggaacgtagttacccgatcaccatcgcggctggtttgtttaacgaaccagcttcattcttgccgctgaaatcaggcgatcaggtcatgttagtgaccaacgaaaccctggcgccgctttatctggacaaggttcgcggcgtactcgaacgggcgggcgttaacgtagacagcgtgattcttcctgacggcgagcagtataagagcctgacggtgctggatacggtgtttacggcgttactgaaaaaaccgcatggtcgtgataccacgctggtcgcgcttggcggcggcgtgattggcgatcttaccggttttgcggcggccagctaccagcgaggcgttcgtttcatccaggtgccaactaccttactgtcgcaggttgattcttccgtgggcgggaagaccgccgtcaaccatccccttggcaaaaacatgattggcgcgttttaccaacccgcttctgtggttgtcgatcttgattgcctgaaaacgcttcccgcacgcgaactggcatcgggactggcagaggtgatcaaatacggcattatactcgacgcagacttcttcacctggcttgagggtaatctggatgcgctattgcgtctggacggcccggcgatggcgtactgtattcgtcgttgttgcgagctgaaagccgaagttgttgccgccgacgagcgtgaagcgggcttacgtgctttactgaatcttgggcatacctttggccacgccattgaagcggaaatgggatatggcaattggttacatggtgaagccgttgccgcaggtatagtgatggctgcgcgcgcatccgagcgtttggggcagttcagttctgctgatacgcagcgcatcatcgcgctactcgaacgggccgggttgccagtcaatggcccttgcgagatgtccgcgcaggactatttgccgcacatgctgcgagataaaaaagtgttagcgggggagctgcgtttagtgcttccgctgaccatagggaaaagtgaagtgcgcggcggagtgtcgcacgaagtcgttcttagcgcgattgctgactgtcagcaggcgtaacaacaagaaaggtcagactgatattgcgtagctgtcagtcttttagcttcaggttatgtgcaatgtcgtaagcattaacctttgagtggggtgttaaatggatgaattcaaaccagaagacgagctgaaacccgatcccagcgatcgtcgtactggtcgttctcgtcaatcttcagaacgcgataatgagccgcagatcaactttgatgacgttgatctggatgccgacgatcgccgtccgacgcgtacgcgtaaagcgcgtagtgaagaacctgaagttgaagaagagtacgaatccgatgaagacgatacggtggacgaagagcgtgttgaacgccgtccacgtaagcgtaaaaaagcggcccataagccagcctctcgtcagtacatgatgatgggcgttggcgtactggtgctgctgctgttgattatcggtatcggctccgcgctgaaagccccctcaacgtcttccagcgagccgtcggcctctggcgaaaagagtatcgatctttccggtaacgccgccgatcaggcgaatgcgacccagcctgcgccgggcgccacctccgcagaacaaaccgcgggcaatacgtcgcaggatatttcgttgccgccgatttcttcaacgccgatgcagggacagtcgcctgtggtcgctgacggtcagcagcgcgtggaagtgcagggcgatctgaataatgcgctgacgcagaatccagagcagatgaacaatgttgcggtgaactctacgttgccgacagagcctgcaaccgtcgcgccagttcgcaatggcagcacgacgcgtcaggcggcggttagcgaacctgccgagcgtcataccacgcgtccggaacgtaaacaggccgtcattgaacttaagaaaccgcagaccacggcgaaaaccaccactgcggaaccgaagaaaccggtcgcgccagtgaaacgcacggaaccggcagcgccagccgcgacgccgaaagcgaccaccacgacggctgcgccgcaagcgacggcaagcgctgcgccggtacaaaccgcgaagccggcgcaagcctcgacgacgcctgtcgcaggcggcgggaaaagcgccggcaacgttggcgcattaaagagcgcgccatccagccactacacattgcagctcagtagttcttcaaattacgacaacctgaacggttgggcgaagaaagagaacctgaaaaattatgtggtatacgagacgacgcgtaatggacaaccgtggtatgtgctggtaacggggatgtatgcttcgaaagaagatgctaaacgtgcggtgtccaccttacctgccgatgtgcaggcgaaaaacccgtgggcaaaaccgttgcatcaggttcaggccgatctgaaataatccaggctgtgtcctgcaattgcctgtgagtgtcgctgacagctattttttttcaggacaggcgcgaggggcgcatttgctaccgtcaaatgcgccgtaaagcaacgcggcacagcctaaagcgcaggatgctgtcggagctttctccacagccggagaaggtgtaattagttagtcagcatgaaaaaaaatcgcgcttttttgaagtgggcagggggaaaataccctctgcttgatgatatcaaacgacatttgccaaaaggcgagtgccttgtcgaaccttttgtgagtgccggatcggtgtttcttaacaccgacttttctcgttatatcctcgccgatatcaacagcgaccttattagcctctataacatcgtgaagttacgtactgacgagtatgtacaggcttcgcgcgagctgtttatgcctgaaactaaccaggctgaggtctattaccaactccgtgaggagttcaacacctgccaggacccctttcgtcgggcggtactgtttttatatctgaaccgctacggttataacggactctgccgctataacttgcgcggggaatttaatgtaccgtttggtcgttataaaagaccttacttcccggaagcggagttgtaccactttgcagaaaaagcgcagaatgcgttcttttactgtgagtcatacgcagacagtatggcgcgtgcggacaagtcgtcggtggtctattgcgatccgccttatgcgccgttgtccgccacggctaacttcacagcgtatcacaccaatagttttagcctgacgcaacaagcgcatctggcggaaatcgctgagaatctggtcagtaaccggataccggtgctcatttccaaccatgatacggcgctcacacgcgagtggtatcaactcgcaaaattgcatgtcgtcaaagttagacgcagtataagcagcaacggcggcacacgtaaaaaggtggacgaactgctggctctgtaccaaccaggagtcgcaacgcctgcaagaaaataattctcaaggagaagcggatgaaacagtatttgattgccccctcaattctgtcggctgattttgctcgcctgggtgaagacaccgccaaagcgctggctgccggtgctgatgttgtacactttgacgtcatggataatcactatgtgccgaacctgactatcggcccgatggtgctgaaatccctgcgtcagtacggtattaccgcgcctattgatgtccacctgatggtcaagccggttgaccgtatcgtgcccgactttgccgccgctggcgcgagcatcattacctttcacccggaagcctccgaacatgttgaccgcacgctacagctgattaaagagcacggctgtaaagcggggctggtattcaacccggcaacgtcgctcagttatctcgattacgtcatggacaaactggatgtgatcctgctgatgtccgtgaacccaggcttcggcggccagtcttttattccgcagacgctggataaactgcgcgaagtgcgtcgccgcattgatgcgtccggttacgacattcgcctggaagtggacggcggcgtgaaggtgaacaatatcggcgagatcgccgcagctggtgcggacatgtttgttgcggggtcggcaattttcgataaacccgactacaaaaaagtgattgatgaaatgcgcagtgagctggcaaaggtaagtcatgaataagttgcagaatattcggggcgtcgcctttgatcttgacggtacgctggtggatagcgcgccgggtcttgccgcggcggtggatatggcgctgtatgcgctggaactgccggtcgcgggcgaggagcgcgtgattacctggattggtaacggcgcagacgtattgatggaacgcgcgctgacctgggctagccaagagcgcgccacgctgcgtaagactatggggaaaccgcccgttgatgaagatattcctgccgaggaacaggtacgcattctgcgtaaactgttcgacaggtattatggcgaagtggcggaagagggcacctttttatttccgcatgtcgccgacacgctgggcgcgctgcacgccagcggattgtcattaggtctggtgacgaataagccgacgccgttcgtcgcgccgttgctggaatcgcttgatatcgccaaatactttagcgtggttatcggcggcgatgatgtgcaaaataagaagccgcatccagagccgttgttgctggtggcaagccgactgggcatgacgccggagcagatgctttttgtcggcgattcgcgtaatgatattcaggccgcaaaagcggcgggctgcccttcggttggcctgacatacggctacaattatggcgaagtgatcgcccttagcgagccggacgtcatttatgacagttttaacgatcttttgcccgcacttgggcttccgcatagcgataaccaggaaataaaaaatgactaagcccatcgtttttagtggcgcacagccctcaggtgaattgaccattggcaactatatgggggcattgcgtcagtgggtaaacatgcaggatgactatcattgcatctactgcatcgtagaccaacatgctattaccgtacgtcaggacgcgcagcagctacgtaaagcgacgctggatacgctggcgctgtacttggcatgtggtattgatcctgaaaagagcactattttcgttcagtcccatgtgccggaacatgcgcagcttggctgggcgctgaactgctatacctatttcggcgagctgagccgtatgacgcagtttaaagataaatctgcgcgctatgcggaaaatattaacgccggcctgtttgattacccggtgctgatggcggcagacatcctgctgtaccaaaccaatctggtgccggtaggcgaagatcagaagcagcatctggaactgagccgcgatatcgcccagcgtttcaacgggctgtatggcgatattttcaaagtaccggaaccgtttattccaaaatccggtgcgcgcgtgatgtcgttgctggagccgacgaagaaaatgtccaaatcggacgataaccgtaataacgtaatcggcctgttggaagatccgaaatcggtagtgaagaaaatcaaacgagcggtcactgactccgacgagccgccggtagtgcgttatgatgtgaaagagaaagcgggtgtctctaacctgctggatatcctttccgccgtgaccggtcagagcattcctgagctggaaaaacagtttgaaggtaaaatgtatggccatttgaaaggcgaagtggcggaggcggtttccggaatgctgtctgagttgcaggagcgctatcaccgtttccgcaacgacgaagcgttcttgcagaaggtgatgaaagacggggcggaaaaagccagcgcacgtgcggccgaaacgctgaaagccgtttacgaagccattggctttgtggcgaaaccgtaacggtaattgcttgcccgatggcgctagcttatcgggcctaccaacgaacgtaagttggacaaggcacctgtgccatactgtttatcagacctgtaaaaaaaccgggaaatcccggtttttttgtatctgcgcagtcgtttctattattgatcggcagccgggccgcaaccgccaataattttagaaatagaaattgcagggtgcagcaaataatcgtagctgcagttattttttttgttttcgatatgaccagtacaggcggtaagcgtcgccagaacccctgccacaacggcaatttttacaaatttaaacatgtcaaaatccttgttgataaaacgaatactactggtggaataaatataagatctatttagcgtatagtacgatagcaattaataaacaatgcaggtagtccaaataaggactttatctttaccagggaatatgatttaaaaaaggccgcttaataataagcggcctatattagtgttatataatgtcgtttatttaacgaaatgttttcttaacgttaagcataaagcctttatcgctgataccgtcttccttccactggtatgcatccagatgtagcgcggtatcattgctgctatatttcacgccgatggttgccaggccattaatgccgccgcctttttgaccgtcatccacgccgaacgattgacccgccgcaccctgtaatgacgctgtacgctggctcttgctgtagctcaggttcgggccgccttccagggtagcggtggcgctccagccgtctttcccggcgtaatccagcttcatacccacaatggaatccaccgctgtttcgctgccagagttcatcgacaggttaaaatcgccagcgttgcgctctttgtagccatcttccatggtatgacggaatttcaccccggcatacggcgtcactttcagcgcatcgtccatcagggagaaggttttcgccccctcgctacggaactccatgtactgctgacgcgcatcggaatcggcaattttgttaacatcgccataggcgacagaacggctgctgtcgaggttgtgtacgtcataacgcaggctgttattccacgccagaccttcatcaaacgccatgctgtgcttcagaccaaagaactggctgtagccgccggtcaggccgttgtcgcccgctttttgcgaaccatcgccgtccagacgggcgataccgtattccagcgtcaggttctggtttgcggttaagtccagtttctgacgcagcgccagcatgtcgtactgggtgtcgttgcccagctcggcgcgcgggtcgcctttcgccaccacgttaaacgccaggccgtctttaatctgcggcgcggcgtcggccagcatgttgaagcggttgcttaacacccgggcttcacggaataccgtagtggcctggctgccgcttacctgtttcagcgcactgttgagttcggcggtggtgcctacgttaaggctggtgtacagctcgttgttggtgtagccagcgtccagcgcctgcgccacgtcagacacgctaccgtcggttgccacatcggcgtaggcgtttttggtcatggtgacgtcaacgttgccgtcgctgtcctgactgccctgggcgttccacaccacgctggtggactggatagcggaagcgtcggtgaggttgctgccctccaccacgttgtcaaagctgacggtggtgtcggcggtgcctgcggtgaagccggtattgatacccacgccttccatgctggcgttgctgaccttaagctggcctgcgctgccgtcggcgttcgtgccaaccacgtagccgttcaggttgttggacgcgccggacgtgtcgccggcggcgaagccggaggtcgtgttgctgccgggttcaacaggcgtttccggcaacgtatagtcggcataatgcgcctcgtcgctgttgccgttattaccgtttgtcccttcgacgttaacgctgtcaccctgtttaataataccggaacccgttacgccatcggcaatgactaccgtcccgttattaaccacatgccccgcacccgccacgctaaacgcgtaagagttattggcgtaaatattaattgtaccgttgttctcaatgacagcattagcggtagcatttttatccagcgccatcgcgaccatgcctgtgtcggtggtgccttctgtacctaaattgatcgtattgttattgaccagttgtgcatttttgccgccatacatgccgtaagcgttattaccgctgatattcatggtgccgtcgttgaccgctacgtaattgttataggcggagaaatcgacggcgcggccattatccgcatcgtaattgattacgccgtttgactggttccagaagaaagcgtgtttatccggggcattacctgcgccgccccccgcataagcaagcaccgcagtagtggcatttaccgtaccgtcattgataaatgccgctcccgcgccccaatagttaatcgcgcccttattggaggttgccgtaagctccatcgtcccggtgttgtacagcgttccgttattcgcattcaggtgaatggcatttttgttgttatcaaggattaacgtaccggtattaaagaattgcgcgaaatcattgatttccagcatggacgcatttttagcgtcagtcgcggagccaagatagaacgtaccgtcgttaatgattgcactgttagcgccagtcacttttgcgccggaagccatggtgccatccgtgcgttagttaatacgccgttggtcgtcaggctacggctgtcaatggtgccattattaacgatatcgccgccattttgcgtcagcgcaccgtttatgacgccgtcattgacaaggttgccggataccgtggtgttgctattgataacgccgctgtcgttgttggtcagcgtgccgctatccaggacggtaatggactcgccgctgaccactccggtattattaacgtctcctgtcacaatcgctttattaccaagcgttgtacttgttccggcatcggcaatcgtagcgccgtctgtgtaagggatagaaacgtcactgtttgttggattgtactcgtcgctgtcctggcaatcgtcgccaaaacagacggtgccgtagttaacaatcaggctattgccgtcggtcaggaaaggcttgccgtaatcggcataaatattgattttgcctgtggtatcgttgacaacggttccgccgttgagcgccgccatgcctaccagttgattcgggtcggtcccttcaacgcccgcatcagcggtcagattaattaccccctggttaatggcggtaccgccgttaagcgccatcatgccgaacccggcgttattgacgttaatggtgccggtgttggtggcggtggcatcgccataaccgctgtcggtggtgcctgcgaccatcgcggcgctggtgacataaagtttcggtggcgtccagtaagttttgtcggtgatgttattttcatcatccagcgtcgggacaaagccgtccaggtagatatcaccagcgttgagcgccgtgcctttgctggcggatacgccgtatacccctgcgccctgcaaatatatggtggcgccggcgtcgttactcacctcgccgtagtcctctgccagcatggcgtacagggtatttttgtaccagattagtgggaagttgcccgcgccggtatttgaaaacggagttaatgatgaaactaaggtgattgtcccttccgcttcattattaacggtggaaccctggccgttagccgcggctatcgcattacggctggacgtccctgttgtggcatacgcggtaatcttgccgctgttttgtgcctgtgcgccgctatccgccagtaataaagcgacggcgccatcgtcaacgacagtgccctgattattgattgaggagccctcgccgctggcggttaacagggcctgcgtcatgtaataattagaaagaataaccgtttcattgatattaaccgttgagttttgatctaacgttaagttgccgccatttctcacattcgccagcgtcaccgcgccgccggggacggtggcaatattgagcgtggattcaccgcttagcgttacgctactgtctccgctgatgtttatactggtaacggctgattcgaggccgtcagcatcttcggtgtagttgatattaataccgccggctaagtccacggtattgccatcacctgccacatcaaggccaacggtattcagatattgttcgtccacgttactcatatcgctgacgttaatattgagcgtgccgctcaggtccaccgcattattgctgccgctgatagacatccccataagggtatcgctgctgccggccatcacgctgtctttgtcatagtcgccgttgaccgtgacgctgccgataatattcagcgtgttgttattccccgtcatgtcgaggcccgtcgcgccacgataaacgttatccccgtcctctgttgcggtgacattaatatcgccatccagcgtcgcttgcgacgcattgccgcttaccagcgcgccggtgccgttaaggctgatgttaatattccccttgtttttgaaggtgttttgttcgcctgcgaccacaaaccccactgagtctacatcacgcacggtggcgttgccggtatttttggcttcatttccggcgccgtaggtgatgatgcccatcgcgccgtcggtgaccagcagatcgcccgcctgggtcaggctgctattgtcgccattaataatcgccgccgcagagcctgcgccatcaacggcgatatcgccggtattggcgatacgggcgtcgtcgccgtcaattcgcgtaccaatggcgccgccggaaatagtctgattaccttcattgataatgagcgcattgtcgccgtcgatatacagcgccgttgagcccgtgccgctgacggtggtgtccccggcgttatcgataaccgcgttatcgccggtgatgtgagcaccggtgccgccatcggtgatggtcatatcaccgtcattgttgacgcgggcgttattgccgtcaatgacggtgccggtggagcctgtgccgttgatggtggaggtaccagtattcttaatcgtggcgttgtcgccgtcgatgatgatggcggtgccgccgccgctcacggcaatgtcaccggcgaaattggtggtggttccgttgccggaaatcagcgcgccggtggcgttgtccaccgttgagtggcccgaaatggtgttggtggtgccatcgccagtgatcaccatgccgatggcgccgtcggtcacactggaacccccggtgagcgtgttgacggttcgattgccggaaataatcacgccggtgcgatcctggccgctgatatccatgccgcgatcggaggtatgcgattcgccgtcgccgctgataacggtggttttatcgtcggcaaggatcagatagccccggctgtcatacttccagtagagaccattttcctgggtgccttcaatcacggcggcattagcgtcggtcacgtcccaaccggtgacgttcagcgttttgccgcccaggggggtgagctgccactggttgttctgttctgaataattccacacggcaccctcgagaacgctgccgctatccagtttgaagctatcgaaggccagggtgtctttgcctttatcgatggtgacgccgttgctgaaggttataacagagtcatccgggggcgtgtcgtcgtcatcgggcggggtcacatcgtcatcgccgctatcgtcgggcggggttacatcgtcatcgccgctatcgtcgggcggggtgacattgccgccatcgtcgggcgtagggggaatataagaatgagtagaatctccgccaccgttattttcaacgccaataaccacacccgcgaccaatgcggcaacgccgccagcaacccagccccagtgattatcattttcaggtaatgtagcaaggcaggtcggtgagagttttgcgcgtttttctttaggcagggaggcgatattactgggacattctttttcatcatcgttattctctgcggcgatggccggaatgtaataactttgcagcgttaaagcgatagcgatagaaataagttttttcttttgcatagagttcatccttaattaatatttccttgcgtactaaacatatgcggatagcgatacaggcaatgatgaaatggccagaagaaaattatgatttagtgtttattttatcacccgataaccaggtcaggtcaaattgaaggcttaacgatattatttattgggtgaatgaataacgggtgaatttgacgaatgaaagggtttttacgcaatataattgctatttaaattcgtttggtgtatttaaaatggattgcttaattcaattttaagtaaaaataattttagattacgagtagttgtaaaataaagccctgaataacagggctttattttaattaatgattagagaaccaatttaatttatcgcgtaaggctaccacgcgaccaacgataatcagcgccgggctttcaacctgttgcgctaattcaccaagctgcgtcagcacaccgtgaacgacgcgttgctttacggaggtaccgttttccaccagcgcaaccggcatattggcctccataccgaatgcgatcagtttttcctggatagtcgctgcctgattcagccccatgtagaacaccagcgtctgtttttctgccgccaggttttcccagtccagctcgccgccggttttcaggtgacccgtgaccagacgtacgctctgtgcgtaatcgcgatgggttagcggaataccggagtaggcggagcagccggaagccgcggtaatccccggtactactgagaaaggaataccggcatgacacagcgtttccagctcttcgccgccgcgaccaaagataaagggatcgccgcctttcaggcgtaccacgcgtttacctttttgcgcttcacgcagcaggatctggttgatttcctcctgtgggacgcagtggtaacccgcgcgtttccccacaaagacccgatcggcatcgcggcgtaccaggttcataatgtcgtcggaaacgaggcgatcgtaaaccacgatatccgcctgttggatttgttgtaatcctttcagcgtaagcagcccggcatcgcccggcccggcgccgaccagcacgacttcgccacggtgatccagcggctcgctaaacaggtgttcagttgtcgcgttaaccgctttctcatcggcattcgccagcgactgcgccagccggtcattgacgaaaaatttttcccagaagcgacgacgttcgcccatggtggcaaactgctttttcactcgggcgcggagctgtccggcatagcgcgcgacctgccccagatgctgcggcagcagcgattccagtttctcgcgcagcagacgcgccagcaccggggaggtgccgccggaggagacggcgaccatcagcggcgagcggtcgataatggagggcatgataaagctggcggctttcggcgcatccaccacgttgcagaagatacggcgtgattccgccgcttcgctgacgcgctggttgacggtatcgtcgtcagtggccgcgatcgccagccaacacgagtcgagaagcgtttcgtcgaacggcccctcaaccagagtcaacatgccttcatttacccatacggtgaactgcggaataaatgttagcgcattgaccgttaaacgtgcgcctgcttccagcagtaaccgtgctttgcgttctgcgacatcgccaccgccgacgatcagacagtcgcggtcgcgcaattgacaaaatataggcaaatggtccacgacattaccccttaatggttggctgtagccttaatttggttggttttttgcggaacagggcgctccgatttcggcgtagcataccaataacccaatcccatgaacacgacgccggacaaagtattgcccagagtgacccataacagattgtgtccgattccggacagggtataggcatcgctgtgatggccaaaccaggagagggcgaacagcgtcatattcgcgacggagtgctcgtagccggaagcgataaacgccagcagacaccaccagatagcaagaaattttgccgtgccttcggtgcggatcgccatccagattgccagacaaaccagccagttacacagcgcgcctttgaagaacagtaccgtggcgggcgcggtggttttcgccagcgcgactgagtgaacgatactggtatcgaccggcaacaaactgccgccgccccagctgtaaagcagggcgacaaacacggaaccaaccaggttgccgagccaggtttgcggcaggatagcccacatttgaccgtggctgatggtgcccgctttgacgcccagcgtcaggaacatggtgtggccggtaaacagttcggaaccggcgatgatgaccagcgttaaggcgataccgaaggtggctcccatcaccaaaggacgcacggacgggtcgagcagattgccgagggtgaaaataagaatgatgccgagaccgacataagccccggccattgccgaactgacccagaagccgagcggattattcgccgacaggcgtgcgatgcgcgcagcgttagccgcacacttattaatagtgtctgtaaacatttgattatccttgaagtataaaaaacaaaaaaatcgtaaccgtaggccggataaggcgtttatgccgccatccggcaatgtgcttttgcaattgcctgatggcgctacgcttatcaggcctaccaataaaagacctacaaatacgtcaaaaaaggggaggcgttgcgcctcccaaaaataattaaccgcgcaactgcaccacgccgtcttttacccgcgcgtcgtaatgcttcacagagaactgctcatcttccatgcacagcccgtcgcttaaacgaaagcgctgctttttcaacgggctggcgacccacagttcgccctggtgttccgcaatcagcccacgagacagcacactggcctcaaagaacgggtcgatgttgctgatcgcaaacacctgatcgctatggtaaggacggaaaatcgccacctgctcgccgcctgacagcgcgcagacgccggttcccggcaggatgtcatcaattttgcagatgttttgccactggctcatgcgttttcctccaccagagtgaccgggatgcgttcatacggcgtggccggacgatgctgttcgcgttcaggcacaacctggacatttgggtcgcgtttgtcgctgttgatgaagtgtttgaaacgaacctgcgccgctggcgtgttgacggtctccgtccactcgcagaccaccgctgcgcgcaggcgcgccatctcttcttccagatgttcgttcaggcccagcttatcgtcgataatgaccgacttcagatattcgatgccgccttccaggttatccagccacggcgcggtacgcgtcagcttatcggcggtacggatgtagaacatcataaagcggtcgaggtacttgatcagcgtgtcgcgatcgagatcggctgccagcagatccgcatgacgcggtttcatcccgccgttaccgcaaacgtacaggttccagcctttctcagtggcgatgataccgacatctttaccctgtgcttccgcacattcacgggtacagccggagacgccgaatttcattttgtgcggggtacgaatgcctttgtagcggttttccagctccacgccgaaaccgacgctgtcgcccacgccgtagcggcaccaggtgctgccgacgcaggttttcgccatccgcagcgctttggcgtacgcgtgaccggtttcgaaaccggcttcaatcaactgacgccagatttccggcagatcgtctttttgcgcgccgaacagaccgatacgctgagaaccggtgattttggtatagaggttaaactcgcgggcgatacgacccacggccaccagaccttccggcgtgatttcaccacccgccgagcgcgggatcaccgagtaggtgccgtctttctgaatattcgctaggaagttatcgttagtatcctgtagcggcgtgtgctgcggtttgaggatgtattcgttccagcacgacgccagcagcgaaccgacggttggcttacacacttcgcagccgtagcctttaccgtgtttcgtcagcagttcttcaaaggttttgataccttccacgcggattaagtggaacagttcctgacgagaataagcaaagtgctcgcacaggttgttgttgacttcaataccctgtttcgccagttcggcgttcagtacctgcgtcaccagcgggatgcagccgccgcagccggttccggctttggtttccgctttcagcgctgccacggtatggcagcctttattgatagcagcgatcagatcgcctttagtcacatcgaagcaggagcagatctgcgcgctgtccggcagtttatccacgccgatagcgggtttaccactgctcgcgtgcgacggcaggatcagcgaatccgggttttccggcagttcgatggcgttcagtaccagttgcagcaaattgccgtaatcgctggtgtcgccgaccagtactgcgccgagcagcgttttgttatcttcgctgacaataagacgtttgtagacttctttgctttcatcgaggtaaacgtagctacgcgcgcccggcgtgcggccatgcgcatcgccaatcccgccgacgtccacgcccagcagcttcagtttggcgctgagatccgcgccttcaaaggcgttttcactgccgaggatatggtcaacggcgacctgggccattttatagcccggtgcgaccagaccgtaaacgcggttgttccaactggcgcactcgccgatagcgtagatatccgggtcggacgtctggcaggtgtcgttaatcacgatcccgccgcgctgcgcgacggccagaccgcactgggtagccagcttgtcgcgggggcgaataccggtagagaagacgataaaatcgacttccaactcgctgccatcggcaaaacgcatagtcttacgcgcttcgttaccctgctgaacaatctcttgcgtgtttttactggtgtgtacacgcacgcccatgctttcgatcttgcgacgtagctgctcgccgcccatttgatcgagttgttccgccatcagcattggcgcaaattcaatgacgtgcgtttccacgccgaggtttttcagcgcgccagcggcttccagccccagcagaccgccgccgaccaccgccccgcgcttgctgcggcgggcgcaggcttcgatagcgttgaggtcttcaatggtacggtaaacgaagcaatcctgggtttcggagcctttaatcggcggaatccacggataggaaccggtcgccatgatcagcttgtcataataaacggtacgacccgcgctggagtgaatcactttctcctgacggttaatggtaattgcgcgttcgccaaccagtacctttacgccgtgcttctcgtaaaatccttcacgcaccagagagagctcttccgcggtgtggtgagagaagtaggatgacaggtggacacggtcataggctttacggggttcttcacagaacacggtaatgtcgaacaggctagcgtcggatttatcaaggagatcctcaataaagcggtggccgaccataccattaccgataatagcgagtctgactttgctcatttttgcctcgatttcttttctattaccgcctaccttaacgattcagcaaccccgcttattgatgtaaatcaaattcacctttatatacctcttaatgggtatatggctgatttgtctgggtttttataagtggcggaattgtcaggcttttcaggtttgtacaaataacatacaaaatgaggggtttttagaccaacaagcctacctcgtcagggggggatagagtgccggagggcgacgtcgccttatccggcctaccaacagcttacgctgtaggccggataagatgcatcgcgtcgccatccggcaatcattattaatgcgccgctggcgaactatgctggcgatgacgggagacaaagccgagcgcaaagcacatcacaaagaccaccgcatacagaccattcgcggtgagtaacgccgcctgtgggccgctgtgagccacaatcgggccggtgacgacgaaggtcagcatcgttccgatggtgccgcaggtcagaataaagttaaccagcttaggcgaggccactttcgtttgctgcgatcccagcgtaatgatggaggtataaatggcgctggagaagaagcccagcgtcagaataaaccacggcatatgcgtctgcgtgccggtaataaacagatacatcagtatcgccgccatacccgccagtacggtcaggatgcgttgcagatcgaaaaagcgcaggataaagctgaacgcccacatgccaaacatataggacatccagaaatcactcaccagcgccccggcgtcattcaggctcatgccgaggcctttggcgtattccggcacccaggagataaagcccaattgaccgaggatatagcacagcgcggcgacggccagaaacagtacgccaatgccccatttttctttgacgacaggcgcctgagagtgctgcgcatgtttacccagcgccggaaattcacagccgaaggtcaggataaaaatcgccaggtagaccaggccgatgcaggcgtagacccagtaccactcaatactacgcgccagcaggaaggcggcgaccataggaaaaatcatccccgccatgctgaagaaggagtcggtaaacagcagtcgggaaccgcgctgacgcccttcatacagttgcgtaatcaggaaggtgccaatcgacatggtgatcccgctgaccagccccagcacaaacatcgccgctgagaacaacgccaggctatggctgaacatcagcccggccaccgccagtaccatcaggataaaaccaaagcgtagctgtgttttcagcgggacgatttccatcaaccacgcattgaggaagatcgagatcaaaatcccggcattcaggaaagtaaaggtgttactcatgctggaaacgggcaactgaaaatagtctgcgatatttcccatcaccatcccggtgacaatcaccagcgccccggtcagggcgtaggaaagaaagctgatccatgtgagcttgatgcggttgctgttagtcatgtctggccttgaagagaagtgaagcgcgtggagggcgcgttaagcgggcagattttaagcgcttttgtgatgtatttaaataattattagtgatagtaatgttcattacattttttaatgtgatgtttgtcacatcatattgcaaggacaaggcgttgcgtcgtaacgttacatttgtttcatgtacgtaaaattaggtaaagggctggcctggcccaggaaggctctttagaatcattccacttgctttatttctgctctctttaaggaaatctcatgctcaaatcgactctggcggctgtcgcagctgttttcgctctttctgctctttctcccgtagcgttggcagcaaaaggtgatcctcatgtgctgttaaccacctccgccgggaatattgagctggagctgaacagccagaaagcgccggtttctgtgaaaaactttgtcgattacgtcaacagtggtttctataacaacactacgtttcaccgcgttattcctggctttatgattcagggtggtggttttaacgagcagatgcagcagaagaaaccgaatccgcctattaagaatgaagccgacaacggtctgcgtaatactcgcggcacgatcgcgatggctcgcaccgcagataaagacagcgccaccagccagttctttattaacgtcgcggataacgcttttctcgaccacggccagcgcgactttggctatgcggtatttggtaaagtggtaaaaggtatggatgtcgccgataaaatctcacaggtaccgacgcacgatgtcgggccttatcagaatgtgccgacaaaaccagtcgttatcctttccgcgaaagtcctgccataaaacatgcctgcgcgggtgcgagccgcccgcgttttctccctgtctcagcgtaacctgaaattgctgcttatacttgtggtcaatcacaggcatattcagggaggccaggtgaagaaacttaccgataaacaaaagtcacgcttttgggaacagcggcgcaacgttaacttccagcaaagccgccgtctcgaaggtattgagatccccttagtaaccctgaccgccgatgaagcgctggcacgtcttgacgagcttcggaggcactatgagcgataaatttggcgaagggcgcgatccgtacctctatccggggctgaatgtgatgcgtaatcggctggggattcatcaggcccagcgactggcgcaagcggcatacgaaatgaccgcgctccgcgccgctacgattgaactggggccgctggtacgcggcttgcctcatctgtgcgcgattcatcgccagctctatcaggatattttcgactgggcagggcaactgcgggaggtcgatatttaccagggcgatacccgtttctgccactttgcctatatcgaaaaagagggcaatgccctgatgcaggatctggaagaagagggctacctggttggtctgacgcacgagaagtttgtcgagcggctggcgcattactactgtgaaattaatgtgcttcatccgtttcgtttggggagcgggctggcgcagcgcatcttctttgaacaactggcgctacatgcaggctacgcgctgagttggcaaggtattgcggttgaaacatggaatcaggcgaaccagagcggcgcgatgggcgatctctccgctttgcgggcgatttttcagaaagcgataagcgaagctcgcgaaactgagtaaaatagggcggttctactgacccggagccgccatgatcctgcttatcgataactatgattcctttacctggaacctctaccagtatttttgtgaactgggcgcggaagtgcaggttcggcgcaatgatgcgctgacgctggcgcacattgacgctttgaacccgcaaaaaatcgttatctctcctggcccctgtacgccaaatgacgctggcatttcactggcggtcatccgccattatgccggacgtattccgatgctgggcgtttgcctgggtcatcaggcgatggcgcaggcctttggcgcgtcggtggtgcgggcagcgaaagtgatgcacggtaaaacgtcacctgttacgcataatggacagggcgtgtttcggggattgcccagcccgttaaccgtgacacgttaccactcgctgattgtcgaccctgccacgttgcctgagtgttttgagatcaccgcctggagcgaaacgcaggagattatgggcattcgccaccgcgagtgggatctggaaggcgtgcagttccacccggaaagtattctcagcgaacaaggacacgctctgctggaaaatttcctccggcgttgatttgtggttgctattgagtgattttttattcatattttgtgattataatttcactggcatttctacttaaccgggtggtaatgatatggcaactgaacaaacggctattacgcgcgcaacttttgatgaggtaattctgcctgtttatgcaccggcggactttattccggtcaaaggtaaaggcagccgcgtatgggatcagcagggcaaagagtatatcgatttcgccggcgggattgcagtgactgcgctgggccattgccatccggcactggtcgaggcgctgaaatcccagggggaaaccttgtggcataccagtaacgtttttaccaatgaaccggcgttgtgtctgggacgtaaactgatcgacgccacgtttgccgagcgcgtgctgtttatgaattccggcaccgaagcgaacgaaaccgcttttaaactggcgcgtcattatgcctgcgtgcgccatagcccgttcaaaacgaaaatcattgccttccagaacgcctttcatggccgttccttgtttaccgtctctgtaggcgggcagccgaaatattccgacggctttgggccgaaacccgccgatattattcacgttcccttcaacgatcttcatgcggtgaaagcggtaatggatgaccacacctgcgcggtggtagtcgagccgattcagggtgaaggcggcgtgcaggcggctacaccggaattcctcaaagggttacgcgacctgtgtgacaagcatcaggcgttgctggtgtttgatgaagtgcagtgtgggatggggcgcaccggagacctgtttgcctatatgcactacggcgtcacgccggatatcctcaccagcgccaaagcgttaggcggcggttttccggtgagcgccatgctgaccacgcaggagatcgcctcggccttccatgtcggttcgcatggttcaacctatggcggcaatccgctggcctgtgcggtggctggcgcggcattcgatattattaatacgccagaggtactacaaggcattcacactaagcggcaacagtttgtgcaacatttgcaggcgattgacgagcaatttgacattttcagcgatattcgcggcatggggctgctgattggcgcggaactgaagccgaagtacaaaggtcgggcgcgcgattttctgtacgcaggcgcggaggccggcgtgatggtgctcaatgccggagccgacgtgatgcgttttgccccgtcgctggtggtggaagaggcggatatcaatgaaggaatgcagcgctttgcgcaggcggtagggaaggtggtggcctgatggcggattgccggataagcgtagcgcatccggcagtcggtcttaaccttttgtatcccgtagccgcttactcagccagataccgtgatgcggacgctgacgccaggccatcgacgaaatggtgtgcatggtgttcagatggccaatgatgcgctgtaaatgttgttccagagtgctcaataagccatgtgacggcatgtccggcgactccagaatattgacatcgccggagccgcctggcctgtcgtactctaggcgctgctggcagcgctgaatcgcaatctcgcaagattccagatagcgctgcgccagatcaggcgtcagcatggtgtgttcccgcgccagcgtcgtcatagcgttgatatgctcgacaataaactggctgtgcgtgacccacagtttcatatccgacagatagtgggtattgaatccgggttcctgcattgcctgatttaacgagttgaataacgtgttatgcgcctggttgacccgcattctttgataagcgagcggggtggcctgcggatcgttactgaggatcagtcggatagcttcttgatcggcttccagcgcatcatgggcgtttttacgtaatagcccgctttgccattgcggccacagccagaccatgccgccaaaggcaattaaacagccaatcagcgtatcgatcagcctcggcacaataaactgctctccgtttaacgtcagtaactggatggtgtataccgccgtcaccgtaaagccgaccgtcgcccagccgtagtttttacgaataatcagataacttgccagcgttagtaccagcatgaccgccagcgtaatgctttcgggaatatgtaagtgcagcgtgacgccggcaatcaccaggccgaccagcgttccgaccgaacggtgcagaatacgtacgcgcgtcgcgccatagctgttttgggtgacaaacagcaccgtcatgaggatccagtacggtttaggcaggtgcaacgcgctgcccatcagactggcgatgctcatcatcacgctgatgcgtccggcgttgcgtagcgccggcgattttagagacatataatttttcagcgccggaagtagcggcagacgacgctgtttatcggccatcaggtcgcgggcgtacagcggccgctgagtacgcagcacacgggcgattcgactgaagtgccaatagcagaactggcctaccggattttcaggatgctgattagcgatcttctccagagcgccaatctgtttttccatggagaagcgcgtcggcagacgatgataaagaatgtcatccgccagcacgcgcagacgggcggcgaccgtttgcgcattccagcgaatcacctcttccgcatggctgcgttctaccagtttctgtacctcttccggctgatgcaagctgacggagatgtgctcctgcaaatccatcgcttcctgaaaagcccgtagtagacgcttgtaatcattattgttgtgcgccgaaagcatatgcatctgttggtaacactgggtaatgagatcgaccgctttttgctggcgtatcagcaggggaggcagcgctttttccggatcgatatgttgggtgagcaggctgtatttcgcttcacaataatcggccagttcacggtataacaaactcaatgactcgcgcagcggctgttcgcgccatagtcagaaccaaaaccagttaaacacgccgtaccatagcgtgcccagcgcataaatgagcagcggctcccagacgggcatgtatcccgcaaggctcagggtaaagatggcggcaatcagcgacgctggcagtagccgcgcgtgaagcgggctaatttccgccgtcacgccaagcaccagcgtgagcccggtcaggatcaacggcagggggatggattccgccagcagaagttgcgttaccagactgcatccggcgaacagcgacgcgccgatgatcaggcgtttaaaaaagcgtttgtgcggggtatccagacctgcaatgttgcagcaggcgggaacgagagagaaaagcaagcccaggtgtagctggcctatcaataaaccaacagccacaggcaggcacagcaccagcgtttgccgtagtgcgtaattaatctctgggtgataaatcagtcttcgccacatcgatgcaaacaaaaatggcgcatgataaaacgcgccattctgacgggattaacgggtgccgtagacgacgatggtcttgccatgcgcggagatcaggttttgatcttccagcattttcaaaatacgaccaacggtttcgcgggagcagccgacgatctggccgatttcctgacgggtgattttgatctgcatcccatccgggtgcgtcatggcatcgggctgtttcgccagattcagcagcgtctgagcgatacgcccggtgacgtcaaggaaggcgaggttacctactttttcagaggtgacttgtaagcgacgagccatctgggaagagaggcgcatcagaatatccgggttgacctggattaattggcgaaattttttgtaggaaatttcagcgacctcacatgcggttttcgcacgtacccaggcgctgcgttcctggccttcttcaaacaggcccagttcaccaataaaatcaccctgattcagataagaaaggatcatttctttcccttcttcatctttgatcagcactgccacggagcctttaacgatgtagtacagcgtttctgctttttcaccctggtgaatcagcgtgctctttgacgggtacttatgaatgtggcaatgagacaagaaccattcaagagccgggtctgtttgcggtttgccaagcaccatgcgcggttatcctctgttataagctgtctccagagccagaaaacggcactgtctctgaggttgcaaaaatatacttcccgctacctgggaagggggctacgaaaatagattgtagcctgtaatgtgatgtcctctgcatacatgcagtacgtcaatgtattactgtagcatcttgtctgttttagcatagctttcgccgtgtgtctcctggtgtctcgcttcagcatgacccaggtcgccttccattgcgagttttgttgtatgcgcgtaatctttcaggaaaattgaaacattggagttacgaaatatgcaagcgcgtgtaaagtgggttgaaggactcacgttcctcggagagtcctcctccggccaccagattttaatggatggtaactccggtgacaaagcgccgagcccgatggagatggtattaatggcggctggcggatgtagcgctattgatgtggtatcaattctgcaaaagggccgtcagaatgtcaccaactgcgaagtgaagctaacatccgagcgccgggaagacgcgccgcgcctgtttacgcacattaatttgcattttatcgttaccggcggcgatctgaaagaggctgccgtcgcgcgcgctgtcgatctctccgcggaaaaatattgctcggtggcgctaatgctggaaaaagcggtcaatattacccattcgtatgaagtgattgcggcgtaacacgtgatgccggatggcggcgtggccttatccggcctacccgtttttatctcgtaggcccgataagcgtagcgccatcgggcatttcaccgcggttattcgatttttttgccttccattaatcgctgcaccagcggcaacataatcagctccatcgccagccccattttgccgcccggcaccactaatgtattaatgtgagaaatgaacgagccctggagcatcgccaggagccagggaaaatcgatcccttccaggttgcggaaatggatcaccacaaaactctcatccagcgagggaataccctttgcggcgaacggattggacgtgtcgacggtcggtacgcgctggaagttgatatgggtacgcgagaactgcggcgtaatgtaattgatgtagtcgtccatggaacgcaccacggaatccatcaccgcttcacgggagtgtccgcgctcgctggtgtcgcggattagtttctgaatccactcaaggttgacgataggcaccacgccaaccaacagatcaacatgacgcgcgacatcatgttgtggggtgacgacgccgccgtgcagtccttcataaaacagcacatcggtcggttcaggaagcggctgccagggggtaaacgtgccgggaacctgattccacggtacggcttcatcataggtatgcagatatttacgcgactggcctttacccgtctgcccgtactcaataaaggtatgttccagtaggctgaagtcattggcttcaggcccgaaatagctgatatgccgcccggcgtcacgcgctttgcggatcgccatgtccatttccgggcgggtgtaacgatgaaaactgtcgccttccacctcggcggcatgcagatttaactgcgcgaaaattttacgaaacgcgaggctggtggtggtggtccccgcgccgcttgaccctgttactgctatcaccggatgtttggctgacatggcaactccatgattgagctttattaataatgtattgtcggcaaaggcgttttattcgcgaaactgctttttcggcataatattgaccgtttcatgtaattcagaccataccagcacggcctcgccggattgcagttggcgttttacgtcagcgactttttgttcaagcgaacgttcatgttcaccataatcggtgccttcgcgcaacacaaagctttcgatcaggttgtccagcgtgtcgggggcgagcccctgccagggaatgatcatgatgacgcctccaggtacgttgtcagccagtcaggaattcggcgttccagccacatttcagggcgcagtggcgtaccgccgataaatcctacgtgtccgccatgctcagtcagctgatactccacctgcgggggcagatcttccgctttagggatcacatgatgatccataaacggatcgtctttagcgtgaataatcagcgtcggtttagcaatctggttaagcaacggcatggcgctacactgacgatagtagtcgatggcgtcggcaaagccgtgaattttcgcggtgatcaggtcgtcaaattcgcgaatacggcgcattgatttcagttgcgccagattcaccggcagcgacccgggatacgccgccagcttgcgtgacgcattcgcttttaacagattaagcaaataacgctgatagacgcgggaaaaccctttgtccatgtggtagctacaggcttcgagaacgaaaggcgcagaaacaattaccgccgcctcgatgggaatatcgcggccttctttcgccagcaggcacgccagcatattaccgccgagcgaatagcccacggcggctgtcggaacggcgccgaactcccgctgtagccagcgtaaaaaccaggctccgtcctccgtttcaccggagtggtaaatacgattcagacggttgggttcgccgctacagccgcgaaagtgcatcaccacgcccagccagccgcgctttatgctttgcctgttgcggttcttcgctccatgccagatcgacaaaatcgccgtccggtagctccagccgctgccagtgggcgttgaacttcactttgcggcggattaaacgtggcagcatagtttgtaaatggcgattacgaatgccacgcatgggaataaattcatgcgagtcattgacaggcggggtcatttctgtggacgtgatctcaaccatagcaccagaacaattgataattggaaacaatactataccgcgcataaggttcacagattagtcaatatgtgattttacgttcaattggtcgtctggcgaaataaaattgcgcctcatttcaccagagggggcggtatgcaaggcgcgcgcaataccccacagaaatcgcgtgaacctctgcatcagccgaattaatcgtggtagtgtggcaacacgatagttatgtgactcaaggagaaggcatgtcgaagacacttttacagatccattttaactttagcggcccttttggcgaggagatgactcagcaactggtcgggctggcggagtctatcaatgaggagccgggcttcatctggaaaatctggacagaaagcgagaaaaaccagcaagctggcggcatttacttgtttgaatccgaagaaacggcgcaggcttatattaaaaaacacactgcgcgtctgaaaaatcttggcgttgatgaggtgacgtttacattatttggcgtgaacgacgcgctgacgaaaataaatcacggcaacctttgccgctaactcacataacgcaggcttctgttccggtgctgccgaccgcaacggtaacctttatatcgggacgagtaccgaagaggcctttatggacgaacagtggacaacgaacgttctcttccagcgtgtgcagcgtctcggcggtgcgggcgatgttacccttctccacaagcatcatgaagatggtgagcttgcggaaggtaatgtcatcggtgatagacaggttcatcgtccgccccgtgcgttagagcctatcccagtaggcgtaattgttgaagccagtttggggccggacagcgcgcagaaaccgtgaggatttcgagcactgcccggccctaaaatggcgaataaaatagcctaatgggataggctcttagtcgttctgcatcatctgctcaagctgctcctgcgcctcaagccatgccatttcacattcttccagcccggatttggcgctggcctgcagttgcagacactcggtcatctccgctttacggcttgggtcatacaggctgctgtcgccaagcttctcttccgcctgcgccagttgggcgttgagcttttccatctctttttccagacgggtaatctctttacgcagcggctgcgttagagtgcgtagctcggcttcgcgacgcttctgatctttgcgtgactgagcgctgttggcgttgttttccttcggtgcgtcgtcggcctggttttcctgcttctgcacgtcgctcagccactgctgataatcctccaggtcgccgtcgaacggttcgacctttttgtcgtgaaccagatagaggtcgtcggtggtggagcgaatcaggtggcggtcgtgcgacacgacgaccaatgcgccttcgaaatcaatcagcgcttcggtgagcgcctgacgcatgtcgagatccaggtggttggttggttcatcgagcagtagcagatttggacgctgccagacgatcagcgccagtaccaggcgcgctttctcgccgccggagaaacgttgcgtctcttccgttactttgtcgccctggaaaccgaagccgccgagatagtcgcgcagcttctgctccagttcctgcggcgccagacgcgccatatgctgcagcggggattcatcggcgcgcaggaactccagttggtgctgggcgaagtagccgagcttaatgcctttggcgaggccgatttcaccgtgcaacggttccagttcgcccgccagcagcttgatcagcgtcgatttccccgcgccgttgcggcccagcaggccgatacgcgagccgggcaccaggttcagcttgatggattccagaatgatgcgatcgccataacctgcgctgactttttccatcttcagcagcgggttcggcaggctttccggcgcgcggaagctgaaatggaacgggttgtcgacatgagccggcgcaatcaactccatacgctccagcatcttgatacggctttgcgcctgcttggccttggtggccttggcgcggaaacggtcgatgtagctttgcagatgcgccacacgctcctgctgactctcatacatcgcctgctgctgcgccaggcgcgtggcgcgctgaacttcaaacgcgctgtagttaccggtgtactcgaacagagtctgctgttcgatatggataattttatccactatcgggtcaagaaaatcgcgatcgtgggagatcagaatcagggtgcctggatagctcttcagccatttttccagccagataacggcatccagatcgaggtggttggtcggttcgtcgagcagcagtaaatcggaacggcaaatcagcgcctgggccagattaaggcgcatccgccagccgccggaaaagtcgctgaccggacgttccagctgatcgttagagaagccgaggccgtgtaacaggctggcggcgcgcgagcgaacggtccatgcgtcgatggcgtccagcttaccgtgtatggaggcgatagcatgcccgtcgttacgttcgttggcgtcgttaagctgcgcctccagatgccggtattcacggtcgccgtcaatgacatactcaatcgctggctgaggcaacgcaggtgtttcctgattcacccacgctaattgccaggttccgggcagggtaaaactcccggcatcggcgctgatttcattttttagcaatgccagcagggtagatttaccgcagccgtttttacccaccaggccgactttctggcctggattaatggtagccgaggcattgtccagtaggacgcgcacgccgcgacgaatttgtaacgaggagaaaacaatcataaggcgccgtatgttcagactatgttaatttatcattatgataatgtaatattcgggcgtaccgccgcgctggagcgcaatggtagctcaaaacaacaacgatacacaaaatcattcaggccgcctttggtgagggacaagaatatctctcattaatccccagcggcggacatggagtacgtttctgagttgaacaaacgctgtcaacgtagaagcggcctgaagaatggcatgtatcgacccaaaacaaccgggagggggattgatgtctcagccagcgaaagtcttgctgttgtatgcccatccggaatctcaggactcggttgctaaccgggtactgcttaaaccggccatacagcacaataacgtaaccgtgcacgatctttatgcgcgctatcctgatttttttatcgatacgccctatgaacaagccctgttacgtgagcacgacgtcattgtttttcagcatcccctttacacctatagctgtccggctttactgaaagaatggcttgatcgcgttttgagtcgagggttcgccagcggaccagggggaaaccaactggtgggaaagtactggcgtagcgtgattacgaccggcgagccggagagcgcttaccggtatgacgcgctaaaccgctatccaatgagcgatgtactccgcccttttgaactgaccgcggccatgtgccggatgcactggatgccgcccattattgtgtactgggcgcgccgccagtcgccgcagacgctggccagtcatgcgaaagcctatggcgagtggctggcgaatcctgtgagcgcgggaggctattgatggaaggtgctgatttattgaccgcgggagtgttgttcctcttcgcggcggtagcggcggtgccgctggccgcgaggctgggcatcggcgcggtgctagggtatttgctggcgggaatcgccatcggtccgtgggggctgggatttatcagcgatgttgacgagatcctgcacttttccgaactgggcgtcgtgtttctgatgtttatcattggtctcgaactcaatccgtcacggctttggcaactgcggcgctctatcttcggcgtcggcgctgctcaggtgctgttaagcgcggcggtgctggcgggattattgatgcttgctgatttcttatggcaggcggcggtcgtcggcgggattggcctggcgatgtcttcgacggcgatggcgctacaactgatgcgcgagaaaggcatgaatcgtagcgagtccgggcagttagggttttccgtcttactgtttcaggatttagcggtgatccccgcgctggcgttggtgcctttattggcgggatcggccgacgagcatttcgactggtttaaagtggcaatgaaggtactggctttcgcggtaatgctgattggcggtcgttacctgctgcgcccggtatttcgttttattgctgcgtctggcgtgcgggaggtcttcactgccgcgacgctgttgctggtgttgagcgccgccttatttatggatgcgctgggactgtcgatggccctgggaaccttcattgccggcgttttactggcagagagcgaataccggcatgagctggaaaatgctatcgatccctttaaaggtttactgcttgggctgttctttatctccgtcggtatgtcgctaaatctcggcgtactttatacccatttactgtgggtggcggcgagcgttgttattctggtcgtcataaaaatgctgacgctgtatctgctggcgcggctatatggaataagaagttctgaacggatgcagtttgccagcgtgctgagtcaggggggcgagttcgcttttgtgctcttttctaccgcctcttctcagcgcctgtttcagggcgatcagatggcgttattattggtgactgtcacattatcaatgatgaccacgccgctactgatgaaagggattgataagtggttatcgcgccgtcttaatggcccggaagagaatgatgaaaagccgtgggttgaggatgataagccccaggtggttgtcgtcggctttggccgttttggtcaggtgatcgctcgcttattgatggcgaataagatgcgtatcaccgtgctggaacgcgatatcggcgccgttaatctgatgcgcaaatatggttataaagtgtattacggcgacgctacacaagtcgagctgctgcgttctgcgggcgcggaggcggcggagtcgatagtcatcacgtgtaatgaaccggaagacacgatgaagctggtggcgctgtgtcagcagcattttcctcatctgcatattcttgcgcgagcgcgtggacgtgtggaggcccatgagttattacaggctggcgtcacgcagttttcccgtgaaacgttttccagcgcgctggaactgggacgtaaaactctggtgtcgttaggtatgcatccgcatcaggcgcaacgcgcgcagttgcattttcgtcggctggatatgcgaatgttgcgggagctgatcccggagcatagcgacatggtacagatttcgcgcgccagagaggcccgacgcgagctggaggagatttttcagcgcgaaatgcaacaggaacggcgccagttggatggctgggatgaatttgagtagaggtgaacaatggcaatccgtaaacgttttattgcaggcgcgaaatgtccggcctgtcaggcgcaggatacaatggcgatgtggcgtgaaaataatgtcgatattgttgaatgcgttaagtgcgggcatcaaatgcgggaagcggataaagacgttcgcgagcatgttcgcaaagaagagcaagtgatcgggatttttcatccggactagcgatatgccgcaggtttttttaagctaaggggtacacggctgcagaattccgctacaatctgcgccactattcttcccatgctcaggagatatcatgaaagtagcaaaagacctggtggtcagcctggcctatcaggtacgtacagaagacggtgtgttggttgatgagtctccggtgagtgcgccgctggattacctgcacggtcacggctccctgatctctggtctggaaaccgcgctggaaggccatgaagttggcgacaaatttgatgtcgctgttggcgcgaacgacgcttacggccagtatgacgaaaatctggtgcagcgtgtgcctaaagacgtctttatgggcgttgatgaactgcaggtagggatgcgtttcctggcggaaaccgaccagggcccggtaccggtagagattaccgaagtggaagacgatcacgttgtggttgatggtaaccacatgctggcgggccagaatctgaaatttaacgtcgaagttgttgcgattcgtgaagcgactgaagaagaactggctcacggtcatgttcacggcgcgcacgatcaccaccacgatcacggtgaagacggctgctgtagcggtcatggtcatgaccatggtcacgagcacggcggcgaaggctgctgcggcggtggtggtaaaggcagctgcggctgccattaatccccgtcgtctttcaagccaccgcggtgttggctacgctttcaaaccccggtcacatcgttatctatgttcccggggaattttcaagcttgccgctttgctgtgactcgaaatccttaggttattatcattggttcgataaatcatcgggcacaaaaaaagcgggtatccccgctttttttcgtctcaataatgcggcggcggcgtttcttctgcctgagaggcgatatttgacggctgactggcttttaacttttccgtgagcaaacgcagatgattgcgcagcttcgccatctccatttcatgtgcggttaccgtcaggtttagttcttctatggtaatctcctggaacgccagacggctttccagttcagccagacgagcttccatcgtgatatcctgcatgatgtacctctttatgttgtctccgtcggcggattctacttaactttaccggctttcacagcaaccattacgcgccctacgaaactaatttaaacaaaaagagtctgaaaagaagtgataatagggcgtgttcgtatgttgatttgttctgcaacgatttatagtacgcttcttacgtaagttaacatggggcgagatgccccggccctggagatatggatgaaatcactgtttaaagccacgctgctggcaacgacgatggccgttgctatgcacgtaccgatcacttttgctgctgatgcggcgaaaccggcagctaccgctgatagcaaagcagcatttaaaaacgacgatcaaaaagcggcttatgcgctgggcgcctcgctgggtcgttacatggaaaattcgcttaaagagcaggaaaagttgggcatcaaactggataaagatcagttgattgccggcgttcaggatgcctttgccgataagagcaaactgtccgatcaggaaattgagcaaacgctgcagacgtttgaagcacgtgtgaagagcgctgctcaggcgaagatggaaaaagacgctgccgataacgaagcaaaaggtaaaacgttccgtgacgcttttgctaaagagaaaggcgtgaaaacctcctctaccggtctgctttacaaagtagagaaagaaggcacaggcgaggcgccgaaagatagcgataccgttgtggtgaactacaaaggtacgctgatcgacggtaaagagtttgataactcttacacgcgcggcgaaccgctctccttccgtctggacggcgttatccctggctggactgaaggcctgaaaaatattaagaaaagcggcaagatcaagctggttatcccaccggcgctggcctacggtaaaacgggcgttccgggtatccctgcgaactccaccctggtattcgacgtagagctgctggatatcaaaccagcgccgaaagcggatgctaaacctgccgatgcggctgacgctaaagccgcagatgctgctaaaaaataaaaactgagagccgccgcttgtaatagcggcggttttttttattcaggccggatatattactcaccataatttgatttgcggataacggcgcttgcgctggtcgttaagggcgagaccgtaggctgaatgaccgccaacgcacacgtagtctgaaatagacgagcaaattagtactggaaagatgaaccctcactgtattaatttaatcatccgcgtaaataatgagcctgccctgaaaacataacgacaggctcctgaaaaggagtgttttttttcatgtccaggtcgcttttaaccaacgaaaccagtgaacttgatttgctggatcagcgtcccttcgagcaaaccgacttcgatattctgaaatcctacgaagcggtagtggacgggttagcgatgcttataggttcccattgtgaaatcgtattgcactctttgcaggatctaaaatgttcagccattcgtattgccaatggcgaacatacgggccgtaaaattggctcgccgattaccgacctggcgttgcgcatgttgcacgacatgacaggggcggacagtagcgtgtcgaaatgctattttacgcgcgcgaaaagcggtgtcttgatgaagtcgttgacgattgccattcgcaaccgcgagcagcgcgtcattggtctactgtgcatcaacatgaatcttgatgtgccattttcacagattatgaatacctttattccgccggaaacgccggaagtcggctcagcggttaattttgcctcctcagtcgaagatttagtcacccagacgctggagttcacgatcgaagaagtgaatgccgatcgtaatgtctctaacaatgcgaaaaatcgtcagatcgtccttaacttgtacgaaaaaggcattttcgatattaaagacgccattaaccaggtagccgatcgtctgaatatctcaaaacacacggtttacctctatattcgccagttcaaaagcggcgattttcaggggcaggataaataatgcgttatgccattatggtcaccgggcctgcatatggcacccagcaggccagcagcgcattgcagttcgcccacgcgctgctcaatgaggggcatgagttagccagcgtctttttctatcgggaaggtgtctataacgccaatctcctgacctcgccggcgagcgatgaatatgatctggtacgcgtctggcagaaattgaatacgcagcatggcgtagcgctgaacatctgtgtcgcggcggcgcttcgtcgcggtattattgatgaaactgaagccggcagactggagttgccgtccgccaatcttcagccgggctttacgctaagcggactgggcgcgctggcggaggcttctctcacctgcgatcgggtggtgcagttttaatgaaacgtattgcatttgtcttttccaccgcgccgcacggtagcgcctcaggccgtgaaggactggatgcgctgctggcgacgtcagcgctaacggaagcgctgggcgtcttttttatcagcgacggcgtctttcagttattaccggggcaaaaaccagacgctgtgctggcgcgtgactatattgctactttcaagctctttgatttgtacgatattgatcaatgctggatctgcgcggcatcgctgcgcgagcgtggtctggaaaacgttaattttgtggtaaacgccacgccgctggaacccgtggcgttacgccgcgagcttggcaactatgatgtcatcctgagattctgaggcgtttatgctgcataccttacctcattgcgcttcgggcgttgattttcccgctttgctgcgcctgctaaaagagggcgatgcgcttttgctgctccaggatggcgttaccgtcgcgattgaaggtaaccgcttccttgaaagtctgcgcgatgcccccataacggtctatgccttgaaagaagacattgacgctcgcggcctgggtggtcaaatttcagacagtgtcgtcagggttgactatactgagtttgtcagactcacggttaagtatgccaaccagatggcctggtgatggcgggatcgttgtatatttcttgacaccttttcgacaccgccctaaaattcggcgtcctcatattgtgtgagggcgttttattacgtgtttacgaagcaaaagctaaaaccaggagctatttaatggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcactgcgtaaagtttgccgtgttcgtctgactaacggttttgaagtgacttcctacatcggtggtgaaggtcacaacctgcaggagcactccgtgatcctgatccgtggcggtcgtgttaaagacctcccgggtgttcgttaccacaccgttcgtggcgcgcttgactgctccggcgttaaagaccgtaagcaagctcgttctaagtacggcgtgaagcgtcctaaggcttaatggttctccgttaagtaaggccaaacgttttaaattaatgtcaaactaaactcgtagagttttggacaatcctgaattaacaacggagtatttccatgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgcctggcgaacgaactttctgacgctgcagacaacaaaggtactgcagttaagaaacgtgaagacgttcaccgtatggcagaagccaacaaggcgttcgcacactaccgttggtaatcccttcggagtcatagtcaccaggcgggcgcttcaggtaagtcgcccgttttggataacttaactgaacgcctaaagatatcaacgaggaatcaaatggctcgtacaacacccatcgcacgctaccgtaatatcggtatcagtgcgcacatcgacgccggtaaaaccactactaccgaacgtattctgttctacaccggtgtaaaccacaaaatcggtgaagttcatgacggcgcagctaccatggactggatggagcaggagcaggagcgtggtattactatcacctccgcagcgactactgcattctggtctggtatggctaagcagtatgaaccgcatcgcatcaacatcatcgacaccccggggcacgttgacttcactatcgaagtagaacgttccatgcgtgttctcgatggtgcggtaatggtttactgcgcagttggtggtgttcagccgcagtctgaaaccgtatggcgtcaggcaaacaaatacaaagttccgcgcattgcgttcgttaacaaaatggaccgcatgggcgcgaacttcctgaaagttgttggtcagatcaaaacccgtctgggcgcgaacccggttccgctgcagctggcaattggtgctgaagaaggtttcaccggcgttgttgacctggtgaaaatgaaagccatcaactggaacgatgccgaccagggcgttaccttcgaatacgaagatatcccggctgacatgcaggacctggctaacgaatggcaccagaacctgatcgagtccgccgcagaagcttctgaagagctgatggaaaaatacctgggtggtgaagaactgactgaagaagagatcaaacaagctctgcgtcagcgcgttctgaacaacgaaatcatcctggtaacctgtggttctgcatttaagaacaaaggtgttcaggcgatgctggatgcggtaattgattacctgccatccccggtagacgtacctgcgatcaacggtattctggacgacggtaaagatactccggctgagcgtcacgcaagcgacgacgagccgttctctgcgctggcgttcaaaatcgctaccgacccgtttgtgggtaacctgaccttcttccgtgtgtactccggtgtggttaactctggtgataccgtactgaactccgtgaaaaccgcacgtgagcgtttcggtcgtatcgttcagatgcacgctaacaaacgtgaagagatcaaagaagttcgcgcgggcgacatcgcggctgctatcggcctgaaagacgtgactaccggtgacaccctgtgtgatccggaaaacccgatcattctggaacgtatggaattccctgagccggtaatctccatcgcggtagaaccgaaaaccaaagctgaccaggaaaaaatgggtctggctctgggccgtctggcgaaagaagacccgtcgttccgcgtatggactgatgaagaatctaaccagaccatcatcgctggtatgggtgaacttcacctagatatcatcgttgaccgtatgaagcgtgaattcaacgttgaagcgaacgtgggtaaacctcaggttgcttaccgcgaagcgattcgcgcgaaagttaccgacatcgaaggtaaacacgcgaaacagtctggtggtcgcggtcagtatggtcatgttgttatcgacatgtacccgctggagccgggctctaacccgaaaggttacgagttcatcaacgacatcaaaggtggtgtaattcctggcgagtacatcccggccgttgataaaggcatccaggagcagctgaaatctggcccgctggcgggttatccggtagttgatctcggtgtgcgtctgcacttcggttcttaccatgacgttgactcctctgagctggcgtttaaactggctgcgtctatcgcctttaaagaaggctttaagaaagcaaaaccagttctgcttgagccgatcatgaaggttgaagtagaaacacctgaagagaataccggtgacgttatcggcgaccttagccgccgtcgtggtatgctcaaaggtcaggaatctgaagttacaggcgttaagatccacgctgaagtaccgctgtctgaaatgttcggatatgcaactcagctgcgttctctgaccaaaggtcgcgcatcgtacactatggaattcctgaagtatgatgatgcgccgaacaacgttgctcaggccgtaatcgaagcccgtggtaaataagccgcagggttaaaaaccaaaatcccgtgctctctcctgaaggggagagcgctatagtaaggaatatagccgtgtctaaagaaaagtttgaacgtacaaaaccgcacgttaacgtcggcaccatcggccacgttgaccacggtaaaactaccctgaccgctgcaatcaccaccgtactggctaaaacctacggcggtgctgctcgtgcattcgaccagatcgataacgcgccggaagaaaaagcgcgtggtatcaccatcaacacttctcacgttgaatacgataccccgacccgccactacgcacacgtagactgcccggggcacgccgactatgtaaaaaacatgatcaccggtgctgcgcagatggatggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccacacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaatatcaaaatggttgttaccctgatccacccgatcgcaatggacgacggtctgcgtttcgcaatccgtgaaggcggccgtactgttggcgcgggcgttgttgctaaagttctgggctaattactcgttaattagttttgaattgaagagggcgcttcggcgccctttttgttgcctgctatttagccgctgttatatttatttgccttttttaacgcttctcccgtggcgtaaatcgctttgtgctattgtaatcataaccattctcatttacactttgtgcggaaattgaacgggagcgatcatgtacgtttgtttgtgtaatggtataagcgataaaaaaatccgccaggctgtacgacaatttcatccacagtcatttcaacagttgcgtaaatttattcctgtgggaaatcaatgtggtaagtgtattcgcgccgcgcgagaagtgatgcaggatgagttaacgcaaatgccggaatttaaagagatcgcctgagtcacactcttttttttgacatccctgtagccccatctacgctctagagagtggaagcggagggactataaaatgaaaggtgatgttaaaatcataaattatctcaataaactattgggaaatgagcttgtcgcaattaatcagtattttcttcatgcccgtatgttcaaaaactgggggctgacccggcttaatgatgttgagtaccatgaatccattgatgagatgaaacacgccgataagtatattgagcgtattttatttctggaaggcataccgaacctacaggatctgggcaagctgggcatcggtgaagatgtcgaagagatgctacgatcggatctccggctcgaactggaaggcgcaaaagatctacgtgaggcaatagcctatgccgataacgttcatgattatgtcagccgggatatgatgattgaaattcttgccgacgaggaaggccacatcgactggctggaaactgagctggatttgattgccaaacttggtatgcaaaattatctgcaatcacaaattaaggttaccgattaaccgtctggaaagaaaactttccaacctgttatgaaacccgccaccgccagccatggcccaaaaggtagcgggtttattaatgccgatttacctctcaccagtagcgcgacgccaaacctgccacaggccaacatagcggcaaggaaaaccagtaacggcagtgtttcccaacaatgccacgcccctaaggcagcaaggtacttgacgtcgccatatccaagcccctctttctgataacgcaggcgatagccccagtaaattaacgcgaatccgccatagccggcgatagcgccccaaagcgcatccggtaaacgctccggcaggcaaatctggtgataaagcagaccaccccacagtaatggacaggtaaaccggtcaggtagcagaccggtacgcgcgtcgtatatgccaagtaataaagagaacgacgcataaaaaatgagaaaggggagggcaacaaacataagcaaatcctcgtcaaggtttgtgctcacctttatagatttatgcgacagcgacaacgacgtattgccaggtttgcctgatgccttccaaagaaaagatgcgcgtcgccatcccatgcgtaccatctggaatcatgctcgcataagaataaagcgcttaatttctatccgacacttgcgtcaggctgagatttacgtataatgcgcgggcttgtcgtaattgacggcaggttcgatttgaacctcgaatagccgatttggctatttaacaatgctcccaatcggggagctacgtaagaacggttacactctcccatcaatcgtaatgggtgtgaggagtaatcattttcgtttataaaataattggagctctggtctcatgcagaaccaaagaatccgtatccgcctgaaagcgtttgatcatcgtctgatcgatcaatcaaccgcggaaatcgtcgagactgccaagcgcactggtgcgcaggttcgcggtccgatcccgctgccgacccgcaaagagcgctttaccgttctgatctctccgcacgttaacaaagatgcgcgcgatcagtacgaaattcgcactcacaagcgtctggttgacatcgttgagccaaccgagaaaaccgttgatgctctgatgcgtctggacctagctgccggtgtagacgtgcagatcagcctgggttaatcaggtcatcgagcgattgagaggttgatacaatgattggtttagtcggtaaaaaagtgggtatgacccgcatcttcactgaagatggcgtctctatcccagtaaccgtaatcgaagttgaagcaaaccgtgttactcaggttaaagacctggctaacgatggctaccgcgctgttcaggttactacgggtgctaaaaaagctaaccgtgtcaccaagccggaagcgggtcactttgctaaagctggcgtagaagctggccgtggtctgtgggaattccgtctggctgaaggcgaagaatacaccgtaggtcagagcatcagcgttgaactgtttgctgacgttaaaaaagttgacgtaaccggtacctctaaaggtaaaggtttcgctggtaccgttaagcgctggaacttccgtacccaggacgctactcacggtaactccttgtctcaccgcgttccgggttctatcggtcagaaccagactccgggcaaagtgttcaaaggcaagaaaatggcaggtcagatgggtaatgagcgcgtaaccgttcagagccttgacgtagtacgcgttgacgctgagcgcaacctgctgctggttaagggtggtgttccgggtgcaaccggttgcgacctgatcgttaaaccagctgtgaaggcgtaaggggatagcaatggaattagtattgaaagacgcgcagagcgcgctgactgtttccgaaactaccttcggtcgtgatttcaacgaagcgctggttcaccaggttgttgttgcttatgcagctggtgctcgtcagggtactcgtgctcagaagactcgtgctgaagtaactggttccggtaaaaaaccgtggcgccagaaaggcactggccgtgcgcgttcaggttctatcaagagcccgatctggcgttccggtggcgtgaccttcgctgctcgtccgcaggaccacagtcaaaaagttaacaagaagatgtaccgcggcgcgctgaaaagcatcctgtccgaactggtacgtcaggatcgtctgatcgttgtcgagaagttctctgtagaagcgccgaaaactaagctgctggcacagaaactgaaagacatggctctggaagatgtgctgatcatcaccggtgagctggacgagaacctgttcctggccgcacgtaacctgcacaaggttgacgtacgcgatgcgactggtatcgacccggttagcctgatcgccttcgacaaagtcgtaatgactgctgatgctgttaagcaagttgaggagatgctggcatgattcgtgaagaacgtctgctgaaggtgctgcgcgcaccgcacgtttctgaaaaagcgtctactgcgatggaaaaaaccaacaccatcgttctcaaagttgctaaagacgcgaccaaagcagaaatcaaagctgctgtgcagaaactgtttgaagtcgaagtcgaagtcgttaacaccctggtcgttaaagggaaagttaaacgtcacggacagcgtatcggtcgtcgtagcgactggaaaaaagcttacgtcaccctgaaagaaggccagaatctggacttcgtcggcggcgctgagtaagtcggaggagtaatacaatggcagttgttaaatgtaaaccgacatctccgggtcgtcgccacgtcgttaaagtggtcaacccagagctgcacaagggcaaaccttttgctccgctggttgaaaaaaacagcaaatccggtggtcgtaacaacaatggccgtatcaccactcgtcatatcggtggtggtcacaaacaggcttatcgtattgttgacttcaaacgcaacaaagacggtatcccggcagttgttgaacgtcttgagtacgatccgaaccgttccgcgaacatcgcgctggttctgtacaaagacggcgaacgccgttacatcctggccccgaaaggcctgaaagctggcgaccagattcagtctggcgttgatgctgcaatcaaagcaggcaacaccctgccgatgcgcaatatcccggttggttctaccgttcataacgtagaaatgaaaccaggtaaaggcggtcagctggcgcgttccgctggtacttacgttcagatcgttgctcgcgatggcgcttatgtcaccctgcgtctgcgttctggtgaaatgcgtaaagtcgaagcagactgccgtgcaaccctgggcgaagttggcaatgctgagcatatgctgcgcgttctgggtaaagcaggtgctgcacgctggcgtggcgttcgtcctaccgttcgcggtactgcgatgaacccagtagaccacccacatggtggtggtgaaggtcgtaactttggtaagcacccggtaactccgtggggcgttcagaccaaaggtaagaagacccgcagcaacaagcgtactgataaattcatcgtacgtcgccgtagcaaataattttagaggataagccatgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccggtatttgtttccgacgaaatggtcggtcacaaactgggtgaattcgcaccgactcgtacttatcgcggccacgctgctgataaaaaagcgaagaagaaataaggtaggaggaagagatggaaactatcgctaaacatcgccatgctcgttcttctgctcagaaggttcgccttgttgctgacctgattcgcggtaagaaagtgtcgcaggctctggatattctgacctacaccaacaagaaagcggctgtactggtcaagaaagttctggaatctgccattgctaacgctgaacacaacgatggcgctgacattgacgatctgaaagttacgaaaattttcgtagacgaaggcccgagcatgaagcgcattatgccgcgtgcaaaaggtcgtgcagatcgcatcctgaagcgcaccagccacatcactgtggttgtgtccgatcgctgagactctggagactagcaatgggtcagaaagtacatcctaatggtattcgcctgggtattgtaaaaccatggaactctacctggtttgcgaacaccaaagaattcgctgacaacctggacagcgattttaaagtacgtcagtacctgacgaaggaactggctaaagcgtctgtatctcgtatcgttatcgagcgtccggctaagagcatccgtgtgactattcacaccgctcgcccgggtatcgttatcggtaaaaaaggtgaagacgtagaaaaactgcgtaaggtcgtagcggatatcgctggcgttcctgcacagatcaacatcgccgaagttcgtaaacctgaactggacgctaaactggttgctgacagcatcacttctcagctggaacgtcgcgttatgttccgtcgtgcgatgaagcgtgctgtacagaacgccatgcgtctgggcgctaaaggtatcaaagttgaagttagcggccgtctgggcggcgcggaaatcgcacgtaccgaatggtaccgcgaaggtcgcgtaccgctgcacactctgcgtgctgacatcgactacaacacctctgaagcgcacaccacttatggtgtaatcggcgttaaagtgtggatcttcaaaggcgagatcctgggtggtatggctgctgttgaacaaccggaaaaaccggctgctcaaccgaaaaagcagcagcgtaaaggccgtaaataaggagcgtcgctgatgttacaaccaaagcgtacaaaattccgtaaaatgcacaaaggccgcaaccgtggtctggctgcaggcgcggatgttagcttcggcagcttcggcctgaaagctgttggccgtggtcgtctgactgcccgtcagatcgaagcagcacgtcgtgctatgacccgtgcagttaagcgtcaaggtaagatctggatccgtgtattcccggacaaaccgatcactgaaaagccgctggcagtgcgtatgggtaaaggtaaaggtaacgtggagtattgggttgccttgattcagccgggtaaagtcctgtatgaaatggacggcgtaccggaagagctggcccgtgaagcattcaagctggcagcagcgaaactgccgattaaaaccacctttgtaactaagacggtgatgtaatgaaagcaaaagagctgcgtgagaagagcgttgaagagctgaacaccgagctactgaacctgctgcgtgagcagttcaacctgcgtatgcaggctgcaagtggccagctgcaacagtctcacctgttgaagcaagtgcgtcgtgatgtcgcacgcgttaagactttactgactgagaaggcgggtgcgtaatgaccgataaaatccgtactctgcaaggtcgcgtggttagcgacaaaatggagaaatccattgttgttgctatcgaacgttttgtgaaacacccgatctacggtaaattcatcaagcgtacgaccaaaatgcacgtacatgacgagaacaacgaatgcggtatcggcgacgtggttgaaatccgcgaatgccgtccgctgtccaagaccaaatcctggactctggttcgcgttgtagagaaagcggttctgtaatacagtacgcattctcaacgaataaacggctcagcgatgggccgtttattttttctacccatatctgatttgcggtgttataatgccgcgccctcgatatggggtttttttaacgacctgattttcgggtctcagtagtagttgacattagcggagcactaaaatgatccaagaacagactatgctgaacgtcgccgacaactccggtgcacgtcgcgtaatgtgtatcaaggttctgggtggctcgcaccgtcgctacgcaggcgtaggcgacatcattaagatcaccatcaaagaagcgattccgcgtggtaaggtcaaaaaaggtgatgtgctgaaggcggtagtggtgcgcaccaagaagggtgttcgtcgcccggacggttctgtcattcgcttcgatggtaatgcatgcgttattttaaacaataacagcgagcagcctatcggtacgcgtatttttgggccggtaactcgtgaacttcgtaacgagaagttcatgaaaattatctctctggcaccagaagtactctaaggagcgaatcatggcagcgaaaatccgtcgtgatgacgaagttatcgtgttaaccggtaaagataaaggtaaacgcggtaaagttaagaatgtcctgtcttccggcaaggtcattgttgaaggtatcaacctggttaagaaacaccagaagccggttccggctctgaaccaaccgggcggcatcgttgaaaaagaagctgcaattcaggtttctaacgttgcaatcttcaatacggcaaccggcaaggctgaccgtgtaggctttagattcgaagacggcaaaaaagtccgtttcttcaagtctaacagcgaaactatcaagtaatttggagtagtacgatggcgaaactgcatgattactacaaagacgaagtagttaacaaactcatgactgagtttaactacaattctgtcatgcaagtccctcgggtcgagaagatcaccctgaacatgggtgttggtgaagcgatcgctgacaagaaactgctggataacgcagcagcagacctgacagcaatctccggtcaaaaaccgttgatcaccaaagcacgcaaatctgttgcaggcttcaaaatccgtcagggctatccgatcggctgtaaagtaactctgcgtggcgaacgcatgtgggagttctttgagcgcctgatcactattgctgttcctcgtatccgtgacttccgtggcttgtccgctaagtcattcgacggtcgtggtaactacagcatgggtgtccgtgagcagatcatcttcccagaaatcgactacgataaagtcgaccgcgttcgtggtttggatattaccattaccactactgcgaaatctgacgaagaaggccgtgctctgctggctgcctttgacttcccgttccgcaagtaaggtagggttactaaatggctaagcaatcaatgaaagcacgcgaagtaaaacgcgtagctttagctgataaatacttcgcgaaacgcgctgaactgaaagcgatcatctctgatgtgaacgcaaccgacgaagatcgttggaatgcggttcttaagctgcagactctgccgcgtgattccagcccgtcacgtcagcgtaaccgctgccgtcaaactggtcgtccgcacgctttcctgcggaagttcgggttgagccgtattaaggtccgtgaagccgctatgcgcggtgaaattccgggtctgaaaaaggctagctggtaattgtcaccaattgaatcacgggagtaaagacagatgagcatgcaagatccgatcgcggatatgctgacccgtatccgtaacggtcaggccgcgaacaaagctgcggtcaccatgccttcctctaagctgaaagtggcaattgccaacgtgctgaaggaagaaggttttattgaagattttaaagttgaaggcgacaccaagccggaactggaactgactcttaagtatttccagggtaaagctgttgtagaaagcattcagcgtgtcagccgcccaggcctgcgcatctacaaacgtaaagatgagctgccgaaagttatggccggtctgggtatcgcagttgtttctacctctaaaggtgttatgacagatcgtgcagcgcgccaggctggtcttggtggcgaaattatctgctacgtagcctaatcggaggaaaaaatgtctcgtgttgctaaagcaccggtcgttgttcctgccggcgttgatgtcaaaatcaacggtcaggttattacgatcaaaggtaaaaacggcgagctgactcgtactctcaacgatgctgttgaagttaaacatgcagataatgcactgaccttcggtccgcgtgatggttacgcagacggttgggcacaggctggtaccgcgcgtgccctgctgaactcaatggttatcggtgttaccgaaggcttcactaagaagctgcagctggttggtgtaggttatcgtgcagcggttaaagggaatgtagtaaacctgtctttaggtttctctcacccggttgaccatcagctgccggcaggtatcactgctgaatgtccgactcaaactgaaatcgtgctgaaaggcgctgataagcaggtgatcggccaggttgcagcagatctgcgcgcctaccgtcgtcctgagccttacaaaggcaagggtgttcgttacgccgacgaagtcgtgcgtaccaaagaggctaagaagaagtaaggtaacactatggataagaaatctgctcgtatccgtcgtgcgacccgcgcacgccgcaagctcaaagagctgggcgcaactcgcctggtggtacatcgtaccccgcgtcatatttacgcacaggtaattgcaccgaacggttctgaagttctggtagctgcttctactgtagaaaaagctatcgctgaacaactgaagtacaccggtaacaaagatgcggctgcagctgtgggtaaagctgtcgctgaacgcgctctggaaaaaggcatcaaagatgtgtcctttgaccgttccgggttccaatatcatggtcgtgtccaggcactggcagatgctgcccgtgaagctggccttcagttctaaggtagaggtgtaagatggctcacatcgaaaaacaagctggcgaactgcaggaaaagctgatcgcggtaaaccgcgtatctaaaaccgttaaaggtggtcgtattttctccttcacagctctgactgtagtaggcgatggtaacggtcgcgtaggttttggttacggtaaagcgcgtgaagttccagcagcgatccagaaagcgatggaaaaagcccgtcgcaatatgattaacgtcgcgctgaacaacggcaccctgcagcacccggttaaaggtgttcacacggggtctcgtgtattcatgcagccagcttccgaaggtaccggtatcatcgccggtggtgcaatgcgcgccgttctggaagttgctggggttcataacgttctggctaaagcatacggttccaccaacccgatcaacgtggttcgtgcaactattgatggcctggaaaatatgaattctccagaaatggtcgctgccaagcgtggtaaatccgttgaagaaattctggggaaataaaccatggcaaagactattaaaattactcaaacccgcagtgcaatcggtcgtctgccgaaacacaaggcaacgctgcttggcctgggtctgcgtcgtattggccacaccgtagagcgcgaggatactcctgctgttcgtggtatggtcaacgcggtttccttcatggttaaagttgaggagtaagagatgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacctggcgaaagtagaaggcggcgttgtagacctgaacacgctgaaagcggcaaacattatcggtatccagatcgagttcgcgaaagtgatcctggctggcgaagtcactactccggtaactgttcgtggcctgcgtgttactaaaggcgctcgtgctgctatcgaagctgctggcggtaaaatcgaggaataagtagcagatggctaaacaaccgggattagattttcaaagtgccaaaggtggcttaggtgagctgaaacgcagactgctgtttgttatcggcgcgctgattgtgttccgtattggctcttttattccgatccctggtattgatgccgctgtacttgccaaactgcttgagcaacagcgaggcaccatcattgaaatgtttaacatgttctctggtggtgctctcagccgtgcttctatctttgccctggggatcatgccgtatatttcggcgtcgatcattatccagctgttgacggtggttcatccaacgctcgcagaaattaagaaagaaggggagtctggtcgtcgtaagatcagccagtacacccgttacggtactctggtgctggcgatattccagtcgatcggtattgctaccggtttgccgaatatgcctggtatgcagggcctggtgatgaatccaggctttgcattctatttcaccgctgttgtaagtctggttacagggaccatgttcctgatgtggctcggcgaacagattactgagcgcggtatcggtaacggtatctcaatcatcatcttcgctggtatcgttgcgggactcccgccagccattgcccatactatcgagcaagcgcgtcaaggcgacctgcacttcctcgtgttgctgttggttgcagtattagtatttgcagtgacgttctttgtagtattcgttgaacgtggtcaacgccgtattgtggtaaactacgccaaacgtcagcaaggtcgtcgtgtctatgctgcacagagcacacatttaccgctgaaagtgaatatggcgggggtaatcccggcaatcttcgcttccagtattattctgttcccggcgaccatagcgtcatggttcgggggcggtactggttggaactggctgacaacaatttcgctgtatttgcagcctgggcaaccgctttatgtgttactctatgcgtctgcaatcatcttcttctgtttcttctacacggcgttggttttcaacccgcgtgaaacagcagataacctgaagaagtccggtgcatttgtaccaggaattcgtccgggagagcaaacggcgaagtatatcgataaagtaatgacccacctgaccctggttggtgcgctgtatattacctttatctgcctgatcccggagttcatgcgtgatgcaatgaaagtgccgttctacttcggtgggacctcactgcttatcgttgttgtcgtgattatggactttatggctcaagtgcaaactctgatgatgtccagtcagtatgagtctgcattgaagaaggcgaacctgaaaggctacggccgttaattggtcgcctgagaagttacggagagtaaaaatgaaagttcgtgcttccgtcaagaaattatgccgtaactgcaaaatcgttaagcgtgatggtgtcatccgtgtgatttgcagtgccgagccgaagcataaacagcgccaaggctgattttttcgcatatttttcttgcaaagttgggttgagctggctagattagccagccaatcttttgtatgtctgtacgtttccatttgagtatcctgaaaacgggcttttcagcatggtacgtacatattaaatagtaggagtgcatagtggcccgtatagcaggcattaacattcctgatcagaaacacgccgtgatcgcgttaacttcgatctacggtgtcggcaagacccgttctaaagccatcctggctgcagcgggtatcgctgaaaatgttaagatcagtgagctgtctgaagaacaaatcgacacgctgcgtgacgaagttgccaaatttgtcgttgaaggtgatctgcgccgtgaaatcagcatgagcatcaagcgcctgatggatcttggttgctatcgcggtttgcgtcatcgtcgtggtctcccggttcgcggtcagcgtaccaagaccaacgctcgtacccgtaagggtccgtgcaaaccgatcaagaaataatcggggtgattgaataatggcaaaggcaccagtttgcgcacgtaaacgtgtaagaaaacaagtctctgacggcgtggctcatatccatgcttctttcaacaacaccatcgtgactattaccgatcgtcagggtaatgcgctgggttgggcaacagccggtggttccggtttccgtggttctcgcaaatccactccgtttgcagctcaggttgcagcagagcgttgcgctgacgccgtgaaagaatacggtatcaagaatctggaagttatggttaaaggtccgggtccaggccgcgaatctactattcgtgctctgaacgccgctggtttccgcatcactaatattactgatgtgactccgatccctcataacggttgtcgtccgccgaaaaaacgtcgcgtataacgcttcgttttccaggttagttggagaaagaaaatggcaagatatttgggtcctaagctcaagctgagccgtcgtgagggcaccgacttattccttaagtctggcgttcgcgcgatcgataccaagtgtaaaattggacaagctcctggccagcacggtgcgcgtaagccgcgtctgtctgactatggtgtgcagttgcgtgaaaagcaaaaagttcgccgcatttacggtgtgctggagcgtcagttccgtaactactacaaagaagcagcacgtctgaaaggcaacaccggtgaaaacctgttggctctgctggaaggtcgtctggacaacgttgtataccgtatgggcttcggcgccactcgtgcagaagcacgtcagctggttagccataaagcaattatggtaaacggtcgtgttgttaacatcgcttcttatcaggttagtccgaatgacgttgttagcattcgtgagaaagcgaagaagcagtctcgcgtgaaagccgctctggagctggctgagcagcgtgaaaagccaacctggctggaagttgatgctggcaagatggaaggtacgtacaagcgtaagcctgagcgttctgatctgtctgcggacattaacgaacacctgatcgtcgagctttactccaagtaaagcttagtaccaaagagaggacacaatgcagggttctgtgacagagtttctaaaaccgcgcctggtagatatcgagcaagtgagttcgacgcacgccaaggtgacccttgagcctttagagcgtggcttcggccatactctgggtaacgcactgcgccgtattctgctctcatcgatgccgggttgcgcggtgaccgaggttgagattgatggtgtactacatgagtacagcaccaaagaaggcgttcaggaagacatcctggaaatcctgctcaacctgaaagggctggcggtgagagttcagggtaaagatgaagttattcttaccttgaataaatctggcattggccctgtgactgcagccgatatcacccatgatggggatgtcgaaatcgtcaagccgcagcacgtgatctgccacctgaccgatgaaaacgcgtctattagtatgcgtatcaaagttcagcgcggtcgtggttatgtgccggcttctacccgaattcattcggaagaagatgagcgcccaatcggccgtctgctggtcgacgcctgctacagccctgtagagcgtattgcctacaatgttgaagcagcgcgtgtagaacagcgtaccgacctggacaagctggtcatcgaaatggaaaccaacggcacaatcgatcctgaagaggcgattcgtcgtgcggcaaccatcctggctgaacaactggaagctttcgttgatttacgtgatgtacgtcaaccggaagtgaaagaagagaaaccagaattcgatccgatcctgctgcgccctgttgacgatctggaattgactgtccgctctgctaactgcctcaaggcagaagctatccactatatcggtgatctggtacagcgtaccgaggttgagcttcttaagacgcctaacctgggtaaaaaatctcttaccgagattaaagacgtgctggcttcccgtggactgtctctgggtatgcgcctggaaaactggccaccggcaagcatcgctgacgagtaaccggatcacaggttaaggttttactgagaaggataaggtcatgcgccatcgtaagagtggtcgtcaactgaaccgcaacagcagccatcgccaggctatgttccgcaacatggcaggttcactggttcgtcatgaaatcatcaagacgaccctgcctaaagcgaaagagctgcgtcgcgtagttgagccgctgattactcttgccaagactgatagcgttgctaatcgtcgtctggcattcgcccgtactcgtgataacgagatcgtggcaaaactgtttaacgagctgggcccgcgtttcgcgagccgcgccggtggttacactcgcattctgaagtgtggcttccgtgcaggcgacaacgcgccgatggcatacatcgagctggttgatcgttcagagaaaacagaagctgctgcagagtaatctgtagtaacgtaaaaaacccgcttcggcgggtttttttatatcctcctgaaccccacatatctacaataattgtattcttttcgttcaatccctggagcgacgtatgtggttacttgaccagtgggcagagcgtcatattatcgaggcacagcgtaaaggcgagtttgataatctgcctggccgcggcgaaccgcttattctggatgatgattctcatgtgccagcggaacttcgtgcgggttatcgcttactgaagaatgcgggctgtcttccccctgaactggagcagcgcagagacgctattcagttacttgatatcctcaacagtatccgggaagatgaccctcaataccatcaggttagtcgccagctctcgctgcttgaactaaaacttcggcaggctgggttgagtaccgattttttacacggtgagtatgcagaaaaactgctgcataaaatcaacgataattaacggagcttgtatgtatcgcattggtgagctggcaaagctggcagacgtaacgcctgataccattcgctactatgaaaaacagcagatgatggatcatgaggtacgtactgaaggcgggtttcgtctgtataccgaaaacgatctgcagcgtctcaagtttattcgttatgcgcggcagttgggtttcacgcttgagtcgatccgcgaacttttatcgatcagaattgatcctgagcaccatacctgtcaggagtcaaaaagtattgtgcaagaacgattgcaggaggttgaagccaggattgcggaactgcaaacgatgcagcgttcgttacaaaggcttaatgatgcttgttgcggaacggcccacagtagcgtctattgttccattctggaagccctggaacagggggccagtggggcgaaatcagtatgttgatttattgaaccggcgggactacactcgcgccgtataatttatacaaacgggagatattatgagtcgttatcaacataagaaagggcagataaaggacaatgccatcgaggcattgttacacgatccccttttcaggcaacgcgttgaaaaaaataagaaaggcaaaggaagttatctgcgtaaaggtaaacacggtaaccgggggaactgggaggccagtggcaagaaagtaagtgacttttttaccactggccttctgcttattaagaacggttattttgttctttcagcagatcgcggatttcgcccaataacacttcctctttagaaggcgcgggcggagctgccggctcttctgcttttttacggttgagtctgttgataagcttaatggcaacaaagatagcaaacgccacaatcacaaaatcaaatacgttctggataaacacgccgtaatgcatgacgaccgccggaatatctccctgcgcttcgcgtaacgtaaaagcaaattgtttaaagtcgatcccgccgattaacaatcccaacggcggcataatgatatcggcaaccagtgaagaaacaatcttaccgaatgccgcgccaataatgacacccactgccaaatccacaacattcccgcgcatcgcgaattcgcggaattctttaataaaactcatttttattctccctatgcagctgacgttataagtttaacaaatgctaaggcattttccatttacggcttctgtttagcgaaataaattaaaccttgataaataaagggaattaaaaagggcgctgaatgagcgccccttaaattagaggaagaaaggacttggctggaacagacgttcgacgtcggtaataaactttttatcggtcaaaaacataatgacgtgatcgccttgttcaatgcgcaaattgtcattagcaatcatgacatcattaccgcgaacgaccgcgccaataatggtgcctggcggcagttttatttcgtcaatgacgcggccaaccacgcgggaagtgctttcatcgccgtgcgcgacggcttcgatggcttcggcaaccccgcgacgtagtgaggaaacgccgacgatatctgctttacgcacatggctcagtaatgcagagatggtggcctgctgcggagaaatcgcaatatctataacgctaccctgcacaagatcgacataagctcgacgctgaatcagcaccatcacttttttggcgcccatccgcttagccaacatcgcggacatgatattggcttcgtcatcgttagtgactgcgataaagagatcgacctgatcaatatgctcctccgccagcaattcctgatcggaagcgtcgccaaaaaagacgatcgtgttttgcagcttctcagccagttctgcggcgcgttgttgatcgcgttcgatcaatttaacgctatagtctttttccagacgccttgccagcccggcgccgatattgccgccgcccaccagcatgatgcgcttgtagggtttttccagacgctgtaattcgctcattactgcacggatatgctgtgaagccgcaataaagaagacttcatcccctgcttccacgatagtcgagccctgaggacggattggtctgtcatgacggaaaattgcggcaacgcgggtatcgatatgcggcatatgctctcgcattgtcgagagcgcgttacctattagtggaccgccatagtaggcttttactactgccagactgactttcccttcggcaaagtttacaacctgtaatgctcccggatactcgatcagacgataaatattatcgataaccaactgctccggcgcgatcagatgatcaatcggaaccgcttcagaatgaaagagtttatccgcatcgcgaacatagtccggggagcgaatgcgggcgatacggtttggggtgttgaagagtgaataggctacctgacaggcaaccatattagtttcatctgaactggtgacagcgaccagcatatccgcatcgtcagcgcccgcttcgcgcaacacgcggggatgcgaaccatgcccctgaactacgcgtagatcgaacttatcttgcaaactgcgtaatcgttcgccgttggtatcaaccaccgtgatgtcgttgttttcgccgaccaggttttccgccagtgttccaccaacttgccctgcgcccagtatgataattttcatcagtcgtggcccgttatctcatcacttcttgattagcttagcgtaaaagaacccatcaccttcttcgccgcccggcagattttgctgtcctggctgatcaggtgttcccgtttcgctgagcgcggcatcgggagtgcgttgcaaaaaggctttgatctgatcgcggttttcttccggcagtacggaacaggtggcataaaccagcgtcccgccgggcttcaggcgcggccagacggcatcaagaatttccgcctgtaattgcgccagttccgcgatatcgcgatcgcgacgcagccatttgatatctggatgacggcgaatgacgccggttgcggagcagggcgcatccagcagaatacggtcaaactgctgctcgccgcaccattgggcgggataacgtccatccccttgtttaactgtcgctttcatcccaaggcgctttaggttgtcgtaaacgcgggagagccgttgttcatcaatatcaaccgccaacacgtctgcttcgggggccacttcgagaatatgcgtggttttaccgccgggcgcggcgcacaagtctaaaatgtgctcaccgttctgaggagcgagaaaaaccgcacatccctgcgcagaggcatcctggacagttacccaaccctcagcaaaaccgggtaaagcatgtaccggagctggcgtttccagacgcacagcgtcgggataatcgggatggggatatcccttcatgcctgcgtcttcaagtaagccaagccaaccgtcgcgggtgtggtgtgtacgatttacacgtagccacataggtggacgctggttattcgcttcaataatgcgttgccactgtgtggggtaagcattttgcaaacgctttaccagccaaccgggatgtaaaaagcgcgcatcgctggtcgcaaactcattaagcaacgtttcctgctggcgctggaactggcgcaggacgccgttaattaaccctttcaactgcggacgtttgatggagaccgcgccttcaacggtttcagccagcgccgcatggggagggacgcgggtgtacagcaactgataaaagccgaccataattaagtaatgcactgtacgctgcttgccggtcattggacgagacatcagcttattgatcagccattccagctgtgaaagggtgcgcaggacgccaaagcacagctcctgaagtagcgctttgtctttatcggcgactttttgttgcagcggcgggagcacattacttaatgattgtccctgttcgacgaccagttcaacggcctgtgctgccagactacgtaaattgttttgttttttcatatgtataaaataaaaatgcccggtaacaccgggcgtataaagacgtgaccgtcaggcaaggcggttaccagggataaaccattcccggcgtgaatttaacagatcctgggcgctcatcgcttttttgccggcaggctgaagcgaaagcaaatttaatatccccttgcctgttgcaacctgaatgccctgtttcgtcgcggccagaatggttcccggcagcgactgcgtggcgtcctcaatgacggatgcctgccagacttttaccggctggccgtcgatttccagccagctcattggccacggattaaaggcgcgaatgcaacgctccagctgtgctgcggagagagaccagtcgatacgcgcttcttctttactgagcttttccgcatgagtgaccagcgcttcattctgcgcttcaggcgtcgctgtgccgtccgccagttgttttagtgtggtaattaacccctgtgggccaagttcagccaacttattatacagtgagccactggtatcttctgcggtaatcgggcacgcaagtttatacagcatgtcgccggtatccagccctacatccatctgcataattgtgacgccggtttccgcatcgcctgcccagagtgagcgctgaataggcgccgcgccgcgccagcgtggaagcagcgaaccgtgaacgttgatacatccgagacggggcatatccagcactgcctttgggagaatcagaccatatgctacgacaaccatgacgtcggcatgtaagtcagccaccagatgctggttttcctgaggacgaagcgacacgggctggaaaacgggcaggcctttttcttccgccagcacttttaccgggctgggcatcaactttttgccgcgacctgctggacgatcgggttgggtaaatacgccgacaatgttatgtccagaagttaacagcgcgtcgagatgacgcgctgcaaagtcaggtgtacccgcaaaaataatacgtagtgaatctgacacgttggttcttgtcctttaagcccgggcgttcaggcggtcgagtttttctactttctgacgaatacgttgttgcttcagcggcgacaaataatcgataaacagtttaccgaccaggtgatccatctcatgctgaatgcagattgccagcaaaccatccgcttcaagctcaaacgggttgccgttgcgatccagcgcgcggattttcactttctcggcgcgcggcactaaagcgcgctgttccgggatcgacagacagccttcttctatacccgtttcgccacttttctccagcaattccgggttaatgagtaccaggcgctcgtcgcggttttccgaaacgtcaatcacgatgatccgctggtggatatcgacctgcgttgcggccagaccgataccttcttccgcgtacatcgtttcgaacatatcatcgacgatacgctgaatttctgcattcacttcttcaaccggctttgcgactttgcgaaggcgctcgtccggaatatgtaacacttgcaaaactgacataattatccagagttgtgttcaggagttgaaaagattattacctctattctagacaaatccccacctgattgacagcatcagtgaccaatcgcaaagattgttcagactgcttgtggcaggggagggaaaggatggcccgtaccgaaatttggttacgtttaatgtacgtcggcgacctttatggcgaggcgatgttgaacatggcgaattcgcttattcgccagcctcagataaatcgcacgcaccttcaggaggctggtcttactgcgcggcaagctgaacgttttttacagcttccagcaggtgtgcttgatgagacgttacgctggcttgaactaccgcagcaccattttctgtgtgcggatagtgagatttatcctcctcaactgcgtgctattgacgattatcccggcgctatttttattgacggcgatcctgcctgtctgcatacctgccaacttgccgtcgtcgggagccggagccactcctggtatggagaacgctggggacgtctgctttgcgaaagccttgcgaaaagcggtttgacgatcaccagcggccttgcccgaggaattgatggcgtagcacacaacgccgcgatgagtatggggggaaaaagtgtagcggtgttagggaatggcttggcaaagatttatcctcgccgacatgccatgctggctgaaaacttgattgccactggcggcgcagtggtctcagaatttccgctttcaacgcctccgctatcgcaaaattttcctcgcagaaaccgtatcatcagcggactgagcaaaggcgtactggtgattgaggcggcgttgcgcagcggttcgttggtgacggcgcgctgcgcgcttgaacaggggcgggacgtttttgcattaccaggccctatcggtagtccgggaagcgaaggcacgcactggttaattaaacaaggggccacgcttgtgacgacgccggaggatattctggaaaatttgcaatacggcttacactggttgccaactacggcggaaaattcactttattcactaaatcaggatgaggcggcattgccatttcctgagctcctggctaacgtaggagatgaggtaacacctgttgacgtcgtcgctgaacgtgccggccaacctgtgccagcggtagtggctcagctactcgaactggagttagcaggatggatcgcagctgtacccggcggctatgtccgattaaggagggcaagccatgttcgacgtactaatgtatttgtttgaaacatacatccataacgaagccgagctgcgcgtggatcaggacagactggagcgtgatctcaccgacgctgggtttgatcgcgaagacatctacaatgcgctgctgtggctggaaaaactcgctgactatcaggatggcctcgcggaacccatgcaacttgcttccgaccctctttcaatgcgcatttatacggttgaagaatgtgaaaggcttgatgccagttgccgggggttcctgttattccttgagcagattcaggtgctaaacctcgaaacacgagaaatggtgattgagcgtgtgctggcgctggataccgcagagtttgacctggaagacttgaaatgggttattttgatggtgttattcaacattccgggctgtgaaaacgcctatcagcaaatggaagaattactctttgaggtaaatgaaggtatgctgcattgataggtgttaatgctgcatgagtgaatatggctaaatcagcactgttttcggtgcgtaaaaatgagccctgcccgcagtgcggggccgaactggtaattcgttccgggaaacatggtccgtttctcggctgttctcgctatccggaatgcgattacgttcgtccgctgaaaagtcaggcggacggacatatcgttaaaattctggaggggcaactgtgtcctgagtgtggcgccgtactggtgctgcgtcaggggcgctttggcatgttcatcggatgcagtcagtatccgcaatgtgaacatacagtggttattgataaaccggatgaaacggcgattgcctgtccagcctgccagcaaggacatttggtccagcgccgttctcgttacggtaaaatctttcattcctgcgatcgctacccggaatgtcagttcgtcattaacttcacaccggttgcgggggaatgccccgagtgccattattcgctactcatcgaaaagaaaaccgcgcagggcgtgaagcgcttttgcgccagtaaacaatgtggaaagccggttccggtggaataaacaagtgaataataacctgccaacaggatctagcgccgcggtggtagatctcctgaataaagaaaatgtcatcgcttatccaacagaagccgttttcggcgtcggctgcgatcccgatagtgaaacagccgttacgcgcctgctggcgttaaaacaacggcccgtcgataagggactcattttgattgccgccagctttgagcagttaaaaccttatattgatgacagcatacttaccgccgcacagcgtaaagcggtatttgattgctggcccgggccggtaacgtttgtttttcctgcgcccgcgacaacgccgcggtggctcacgggacgttttgattccctggccgttcgtgttaccaaccacccgctggtggtcgcgctatgcaatgcgtatggcaaaccgctggtttccaccagcgccaatctgagcggattaccgccatgccgtaccgttgaagaggtgcgtgcgcaatttggcgatgattttccggtggttgaaggcgcaacgggtgggcgtttaaatccttcagaaatccgcgatgctctgacgggcgaactatttcgacaggggtaatatgatggaagcctatgctgtttttggaaatccgattgcgcacagcaaatcgccatttattcatcagcaatttgctcagcagctagatattgttcacccctatggtcgcgtgctggcccccattaataatttcattaatacgcttgatgcctttttcgcggcagggggaaaaggcgcaaacatcacagtaccttttaaagaggaggcgtttgcgcgttcggatgagttaacggaacgagcatcgctggcgggagccgtcaatacattaaaacggctggaagatggtcgtttgcttggcgacaatactgacggtatcggtttattaagcgatctcgaacgtttaaattttatccgcccaggattgcgtattttgctgattggcgcgggcggcgcatcccggggcgtgctgttacccctgctttctttggattgtgcggtcactatcactaaccgtacagcttcacgtgccgaagcgttggcgaaaatctttgctcataccggcagcgttcatgctatggatatggacaagctggatggttgtgagtttgacctgattattaatgcgacctccagcggcatacggggcgaaatcccggcgattccggcgtcacttattcatccttccctctgttgctatgacatgttctatcaaaaagggaatacgccatttctctcctggtgtgtacaacagggcgcgaaacgctacgcagatgggctgggaatgctggtggggcaggctgcacatgccgttttgctttggcacggtgtattaccgcaggtcgagccagtgattaagctgctacagcaggaattattagcgtgaaccaggccatacaattccctgaccgcgaagaatgggatactgccgccagcgctatcatctttcccgccctggtcaatgggatgcaaatcacgtgtgcgataaaaaaagatgtactggcgtatcgctttggtggagaaacagcggagcaatggctggccatttttcgtgagtatcgctgggacctggaagaagaggctgaagcattaatcctggcccagcaggaagacgatcacggttggatatggttatcctgagaaagatagtcgtctttccattttacatagttattggcggagtactgcaggcccgatctctcagcatcgctcagggggcggatctgttttaccggactgccaagatataaatagccgctttccagccgtttgtgctgcggcaccaggcttcccgcgccaatcattacgtcatcttctattatcgcgccatccagcacaatggagcccataccgaccagtacgcggttaccgatggtacagccgtgcagcataactttatggccaacggtaacatcttcgccaatgattaatgggttgccgtgtggattggatggagacttgtgggttacgtgaagaacgctgccatcctgaatgttcgtacgagcccctatcgcaacgtaattcacatcgccgcgaatcaccacaagcggccagatcccgacatcatccgccagacggacatcgccaataaccacgctgctggtatcgatcatcacgcgctgaccgatttcaggaaaaagatccttataaggacgtaatgtgtcagacatgtctacctcatcataaatgaatagtcatgaagactttggttgctttaacggcgttgtgcaaggggagatagcatcaaaaaatcgccactttgcgcaggaatggagcgaaagggatgaaaaatcaacaaacagaaaaaagatccaaaaaacgcttgtgcaaaaaaatgggatccctataatgcgcctccatcgacacggcggatgtgaatcacttcacacaaacagccggtcggttgaagagaaaaatcctgaaattcagggttgactctgaaagaggaaagcgtaatatacgccacctcgcgacggtgagctgaaagccgcgtcgcacctgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttaccttaaagaagcgtactttgcagtgctcacacagattgtctgatgaaaagtgaatagcaaggcgtcttgcgaagcagactgatacgtccccttcgtctagaggcccaggacaccgccctttcacggcggtaacaggggttcgaatcccctaggggacgccacttgcgcggtaatgtgtgaaaggcgttgccatcagtatctcaaaactgacttacgagtcacgtttgagatatttgctctttaaaaatctggatcaagctgaaaattgaaacacagaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagccccaccactaagccagtggtgaactccacatacgcatcctttgctgaggagacggttaacggagcgaaagcgacgttcaacctcaaaagaagcagagggggcttagtggtggggtgactgcgtaccttttgtataatgggtcagcgacttatattctgtagcaaggttaactgtataggggagccggagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaatgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacaccgtgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtatgtgttccaggtaaatccggttcactttaacactgaggcgtgacgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcacggagctgaagtcagccgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagactttaggtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagacgattttcagcactgattccggattttcgggaacgaaagataaaagattcgtttccggcaacagaatttgcctggcggcactagcgcggtggtcccacctgaccccatgccgaactcagaagtgaaacgccgtagcgccgatggtagtgtggggtctccccatgcgagagtagggaactgccaggcatcaaattaagcaaaaggctcagtcgaaagactgggccttttgttttatctgtggtctgccggtgagcactctcctgaggaggacaaatccgccgggagcggatttgaacgttgcgcagtaacggcccgtagggtggcgggcagcacgcccgccataaactgccaggcatcagacaagtgaagaagcccatcctgacggacgggcttttttgcgtgtgtggtaactgataaaaatgtaggcctgataagcgcagcgccatcaggcaacctgcaccgccggatggcggcttcgccttatccggcctgcatgcacttatcaggcagcgccactactcacggataaattaaattcaacaatggatacggtttcccaagatcgtcgacctccgaacgtcccgtcaccttgaatcccattttcttataaaattcaacagcttgtgtattttgctcgttaacattggttgtcaatcccggcgccagtgttaatgcatgttcaaccagcatcttaccgataccctgaccacgcacgtccggatcgataaacagagcatccatatgctcaccggtaagcagcataaaccctaccggctcatcctgatcggtcacggcaacccatagtggcgcttctggcagaaaatcgctcaccagttcttccagttcggcccgataagcgtttgacagaaaatcgtgcgtggcatcgactgagcgacgccagatcgcaatcagtttttccccttcctcacgccttgaacgacgaatgttaatcatcatcttcactccttttttgcttacttctattctaatgcaaatgctgtcgtgaaactttctcaccttgaacttgcagactcgacattcgcctgatttctgagtatcttcagctatctggatgtctaaacgtttaaacgtatatcgtgaggttatcaggttatgccgattcgcgtgctggacgagctacccgccgtcaattttttacgtgaggagaatgtcttcgtcatgacgacttctcgcgcatcaggtcaggaaattcgcccgctaaaggtacttattcttaacctgatgccgaagaagattgaaacggaaaatcagtttctgcgtttgctatcgaactcgccattgcaggtcgatattcaactactgcggatagatgcccgcgagtcgaggaacacgccagccgagcatctgaacaacttttactgtaacttcgacgatatctgcgatcagaactttgatgggcttatcgtgaccggagcgccgctgggtctggtggagtttaatgacgtggcttactggccgcagattaggcaggtgctggaatgggcgaaagatcacgttacttcgacgctatttgtctgttgggccgttcaggccgcactcaatattctttatggtatccctaagcagacccgtacagataaactttccggcgtctatgaacatcacattcttcatccacatgctctgttaacgcgtggttttgatgattcgtttcttgcgccacactcacgctatgccgatttcccggcggcgctaatacgggattatacggatcttgaaattctggccgaaacagaagaaggggatgcgtacctgtttgccagcaaagataaacgtattgcgtttgtcaccggtcatcctgaatatgacgctcatacgttagcgggggaatattttcgtgacgttgaggccgggttaaatccggagattccgtacaactatttcccgaaaaacgatccgcaaagcataccgcgcacaacctggcgcagccacggcaatttactgtttactaactggctcaactattatgtctactagattacgccatatgatctgcgtcacatgaatccaaccctggattaatcttctgcttctgacaatcctaaagcgtttcagcatgttgaatcaggcaccttcgggtgccttttttatttccgaaacgcacctcatcatgtaattaaatttaatttatattgttatcaataggttaatgtgtaattaaattaaaaatggaaattgtttttgattttgaaatttaattgagtagtcttagttgtgttgaacgaaaagcgcacagtgatccttcgttcgcattggggatgtatctggatcaacaacgaggagctgcatgatgaatccacaggcaaccacaactgatgaattaacctttaccaggccgcaaggcgagctggaaaagcaagtcctgaccgctgaggcagtcgagtttttgacggagttagtcacccgttttacgccaaaacgcaataaactcctggctgcacgtatccagcaacagcaggatattgataacggtaagttgcctgattttatttcggaaaccacttccattagagaaagtaattggcagattcgtggtattccggcggatttacaggatcgccgagtagaaattaccgggccggttgaacgtaaaatggtgattaatgccctgaacgcaaatgtgaaagtgtttatggcggattttgaagactcgctggcgccggactggaataaagttattgatggtcaaatcaacctgcgtgatgcggtgaacggcaccattagctataccaacgaagccggaaaaatctatcagctcaagcccgatccggccgtattgatttgtcgtgtacgcggtctacatctgccagaaaaacatgttacctggcggggggaagccattcccggcagcctgtttgattttgctctgtactttttccacaactacaaagcgctgctcgctaaaggtagcggcccgtatttttacctgccgaaaacgcaagcctggcaggaggcagcctggtggagtgaagttttcagctacgccgaagaccgcttcaatctaccgcgcggtacgatcaaagcgaccctgttgattgaaacgctgcctgctgttttccagatggatgagattcttcatgcgttgcgtgatcatatcgtcggtctcaactgtggtcgctgggattatattttcagctatatcaaaacgttgaaaaatcacccggatcgcgtcctgccggacaggcaggtggtaacgatggacaaaccgtttctgagtgcctactcgcgcctgctgatcaaaacctgtcacaagcgcggcgcgttcgcgatgggcggtatggcggcgtttatcccgagcaaagacgttgaacgcaataatcaggtccttgccaaagtgaaagcggataaagcgctggaagcgaacaacggccacgacggcacgtggattgcgcatcccgggttggcggatacggcaatggccgtctttaacgaggtactgggcgagtacaaaaatcagctgttcattacccgtgatgaagatgcgccgattaccgctgagcagttactggagccatgtgaaggcgaacgcacagaagcgggaatgcgcgccaatattcgcgtggcagtgcagtacattgaagcgtggatccccggcaatggctgtgtaccgatttacggtctgatggaggatgccgcgacggcggaaatctcacgaacctctatctggcagtggattcaccatgagaaaacactgagcaatggaaaacccgtaacgaaagcgcttttccgcgaaatgttggcggaagagatgcgggtaatccaggacgaactgggcgagcaccgctacagcagcgggcgcttcgacgatgccgcacgtctgatggagcaaatcaccacatcagatgacttaatcgacttcctcaccctgccgggctatcgcttactggcttaattcaccacataacaatatggagcatctgcacatgaaaacccgtactcaacaaatcgaagaattacagaaagagtggacacaaccgcgctgggaaggcatcacccgcccgtacagcgcggaggaggtggtgaaattacgcggctcggttaacccggaatgcacgctggcgcagctcggcgccgcgaaaatgtggcggctgttgcacggtgaagcgaaaaaaggctatatcaacagcctgggcgcgctgactggcggtcaggcgctgcagcaggcgaaagccggtattgaggcgatttatctttcaggctggcaggtggtggcagatgccaacctggcatccagcatgtatccggatcaatcgttgtacccggcaaactctgttccggcggtagtggatcggatcaacaacactttccgtcgtgcagatcagatccagtgggcatccggtattgaacccaacgatccgcgctatgtggattacttcctgccgatcgttgctgatgcggaagccggttttggcggcgttctgaatgccttcgaactgatgaaatcgatgattgaagccggtgcagcggccgttcacttcgaagatcagctggcgtcggtgaagaaatgcggccatatgggcggcaaggtgctggtccccacgcaggaggcgattcagaaactggttgctgcgcgtctggccgctgatgtgatgggcgtcccgacgctggtgattgcgcgtaccgatgcggatgcggcagatctgatcacctccgactgcgatccctatgacagcggttttattaccggcgaacgcaccagcgaaggtttttaccgcacccatgcgggcattgagcaggcgatcagccgcggtctggcgtatgccccgtatgccgatctggtatggtgcgaaacttctacgccggatctcgaactggcgcgtcgttttgccgatgctatccacgcgaagtatccgggcaaactgctggcctataactgttcgccatccttcaactggcagaagaatctggacgacaagaccattgccagcttccagcagcagttgtcggacatgggttacaaataccagtttattaccctggcgggcatccacagcatgtggttcaacatgttcgacctggcgcatgcatacgctcagggtgagggcatgaaacactatgttgagaaggttcaacaacccgagttcgccgcagcgaaagacggttacacctttgtttcccaccagcaggaagtgggtactggttacttcgacaaagtcaccaccattattcagggcggcgcgtcatccgttaccgcgttaacgggttccaccgaagaatcgcagttttgattgatgcccggtggcgctgcgcttaccgggcctacagatagcgtaggccggataagcgaacgcgccatccggcatgatgtggtgccggatgagggaaaaaatgccgcgtggcctggaattactgattgctcaaaccatcctgcaaggctttgacgcgcagtatggtcgatttctggaagtgacttccggcgcgcagcagcgttttgaacaggccgactggcacgccgtccagcaggcgatgaaaagccgtatccacctctatgatcatcatgtgggtctggtggtggagcaactgcgctgtattaccgatggcaaaagtaccgacgcggatttccttttacgcgttaaagagcattacacccggctgttgccggattacccgcgcttcgagattgcggagagctttttcaactccgtttattgccggttatttgaccaccgctcgttaacacccgagcggttgtttattttcagttcgcaaccggagcgtcgcttccgtactatcccgcgcccgctggccaaagacttctttcccgatcacggttgggagccgctgttgatgcgcatactcagtgacttaccgctgtgtctaccctggcagaataaaagccgggatatccgctatattatcgcgcacctgactgaaacactgggcgaggacgcgctacctcgctgccatgtccaggtggcgaacgagttgttttactgtaataaagcggcctggctggtaggtaaattaaccacacctgacggtacgctgccgtttttattgccgattcatcgcactgatgagggggaactgtttgtcgatacctgcctgaccaccacggcagaagcgagcattgtgtttggttttgcccgctcttattttatggtgtatgcgccgctgcctgccgcgctggttgagtggttgcgtgaaatcctgccgggtaaaaccactgccgaactgtatatggcgattggctgccagaaacatgcgaaaaccgaaagctaccgcgaatatttatgttatctggctgaaagcgatgagaaattcattgaggcgcctggaatccgcggcatggtgatgctggtatttaccctgccaggcttcgaccgggtatttaaaatcattaaagacaaattcgccccgcagaaagagatgtctgccgcccatgtgcgtgcctgttatcaactggtaaaagagcatgatcgcgtcggtcgtatggcggatacccaggagtttgagaatttcgtactggataaacggcaaatcgatccggcgctgatggcgctgttacgacaagaagcgccagagaagattaccgatcttggggaacatatcgtcattcgtcatctctatattgaacgtcgcatggtgccgctcaatatctggctggaacaggtagaaggccagcagttgcgcgatgcgatagaagaatatggtaatgcgattcgccagcttgccgccgctaatattttcctcggcgatatgttgtttaaaaactttggcgttacccgtcatggtcgcgtggtgttctacgactacgatgaaatttgctacatgacggaagtgaatttccgcgatattccgccagcgcgttatccggaagacgaactggccagcgaaccctggtatagcgtctcgccgggtgatgttttcccggaggagtttcgccactggctgtgtgccgatccgcgtatcgggccattgtttgaagagatgcatgccgacctgtttcgcgccgattactggcgcgcgctacagacgcgtattaaagaagggcatgtagaagatgtgtatgcctatcgtcgccgccagcgctttagcgtgcgttatgaaaccgaccgtaggccggataaggcctttgcgccgccatccggcaatgtacgccgtgcctgatggcgctgcgcttatcaggcctacaaatcagttccaacccttgcttatctaaacccaccataggccagcgtcacctctttcgccgctttaatcaccatggcgccaagttcggtgacgcgatcgtcggtaatgcgtgagcaggggccggaaatagagagggccgcaaacggttcgcggtgttcgtcataaatacacgaggccacgcagcgcagaccgagcgcatgttcttcgtcgtcaaaggaatagccgcgcttgcgtgtttgggcgaggtcatctttcagatgcagcggcgacaccagcgtcgcatgggtataagcgtgcaaccccttgcggtgcagcagactggtaacctgttcctcactgagctgtgataaaaacgccttgcccgcgccagaggcgtgcatgggcagcttgccgccaataggggcggacatgcgcatcaattgtgtgcactgcacctggtcgataataatagcctgatggtcgctctggtcgagtacggcaaggtttaccgtttcgccggagtcctccatcagcttgcgcaaaatcggatggacaatcgccagcagattacggctctgtaagaagctgctaccgacgataaacgcgtgtgcgcctacggcccagtggcccagctcaccaacctggcggacaaaaccctgttgctgcatggtggtgagtagacggtgagtcgtggaattaggcaaacccgcctgttgcgccagttcggtcagcgcgacgctgccgttggactcggcaatccactccagcagcttcagaccgcgagttaaagactgaacctgcccggttacgggtgcagtggtagcggcaggttttctcccgcgttttgcgggaacaggggcaaccatggcagactcctttttctgtatcgtggaaatcattttcgttttattcaattataatgcaagagttcctgaactgatcggatgagtgacatcacaggatgcccgatggcgctgcgcttatcaggcctacgctttgggagccgccaaagtaatttgtagactgataaggcgcttgcgccgccatccggcaaagcgacagaagtgggtggcaagctgaacatgtctcatgttgcccgttgttctcttttccgccagcacgctttgtgccagtatggctcgttacgtggagcgttgtcgggagcgagtgtgagcagcaaagttgaacaactgcgtgcgcagttaaatgaacgtattctggtgctggacggcggtatgggcaccatgatccagagctatcgtctacatgaagaagatttccgcggggagcgctttgccgactggccctgcgacctgaaaggcaacaatgacctgctggtcctcagcaagccggaggtgatcgccgctatccacaacgcctactttgaggctggcgcggatatcatcgaaaccaacacctttaactcgacaaccattgcgatggcggattaccggatggaatccctgtcggcggaaattaactatgcggcggccaaactggcgcgcgcctgcgccgatgaatggacggcgcgaacaccagaaaaaccacgctttgttgcgggcgtgcttggtccaactaaccgcacggcctccatttcgccggacgtcaacgacccggcgtttcgtaatatcaccttcgatcagctggtggcggcctaccgtgaatccaccaaagcgctggtggaaggcggggcggacctgatcctgattgaaactgtcttcgacaccctcaacgccaaagcggcggtgtttgcggtgaaagaagagtttgaagcgctgggcgttgatctgccgatcatgatttccggcaccatcaccgacgcctctggccgtacgctttccggccagacgaccgaagccttttataactcgctgcgccacgccgaggcgctcacttttggccttaactgcgcgctggggccagatgaactgcgccagtacgtccaggaactgtcgcggattgccgaatgctacgtcaccgcgcacccgaacgccggcctgccgaacgctttcggcgagtacgacctcgacgccgacaccatggcgaaacagattcgcgaatgggcggaagcgggcttcctgaatatcgttggcggctgctgcggcaccacgccggagcatattgcggcgatgagccgcgccgttgccggtttgtcgccgcgccagctgccggatatcccggtggcctgccgcctttccggcctggagccgctgaacattggtgacgatagcctgtttgtcaacgtcggcgaacgtactaacgtcaccggctcggccaaatttaaacgcttgatcaaagaagagaaatacagcgaagcgctggatgtcgcccgtcagcaggtcgaaagcggcgcgcagattattgatatcaatatggatgaggggatgctcgacgccgaagcggcgatggtgcgtttcctcagcctgattgccggtgagccggacattgcccgtgtaccaatcatgattgactcctccaaatgggaggttatcgaaaaagggctgaagtgcattcagggtaaaggcatcgtcaactctatttcgatgaaagagggcgtggaagcctttattcatcatgcgaagttgctacgtcgctacggcgccgcagtggtggtgatggcttttgatgagcaggggcaggccgacacccgcgaacgtaaaatcgagatttgccgccgcgcttacaaaattttgctcgaagaggtaggctttccgccggaagacatcatcttcgacccgaatatcttcgccgtcgccaccggtattgaagagcacaacaactacgcgcaggactttatcggcgcttgtgaagacatcaaacgcgagctgccgcacgcgctgatctccggcggcgtgtctaacgtgtccttctcgtttcgcggcaacgacccggtacgtgaggctatccacgcggtattcctctactacgccatccgcaacggcatggacatgggcatcgtcaacgccgggcaactggcgatttatgacaacctgcctgccgaactgcgcgatgcagttgaagatgtcattcttaaccgtcgcgatgacggcaccgagcgtttgctggatttggcggagaaatatcgcggcagcaaaaccgacgaggctgccagtgcccagcaggcggaatggcgtagctgggacgtgaaaaagcgtctcgaatactcgctggtgaaaggcattaccgagtttatcgaacaggataccgaagaagcccgtcagcaggccgcccgcccgattgaggtgattgaagggccgctgatggacggcatgaacgtggtcggcgacctgttcggcgaagggaaaatgttcctgccgcaggtggtgaaatccgctcgcgtgatgaaacaagcggtggcctacctggagccgtttattgaagccagcaaagaaaaaggctccagcaacggcaagatggtgattgccaccgtgaagggcgatgtgcacgacattggcaagaacattgtcggcgtggtgctgcaatgcaacaactacgaaatcgtcgatcttggcgtgatggtgccagcggagaaaatcctcagaacggcgcgtgaagtgaatgccgatctgattggtctttccgggcttatcaccccgtcgctggacgaaatggtcaacgtggcgaaagagatggagcgtcagggctttactatcccgctactgatcggcggcgcaaccacttcgaaagcgcatacggcggtgaaaatcgagcagaactacagcggtccgacggtctacgtgcagaatgcttcgcgtaccgtgggcgtggtggcggcgctactctccgacacccagcgtgatgactttgtcgcccgtacccgcaaagagtacgaaaccgtgcgtattcagcacgcccgcaaaaaaccgcgcacgccgccggtcacgctggaagcggcgcgcgataatgatctggcatttgattgggaacgctacaccccgccggtagcccaccgtctgggcgtgcaggaggtggaagccagcatcgaaacgctgcgcaactacatcgactggacgccgttctttatgacctggtcgctggccggcaaatacccgcgcattctggaagatgaggtggtgggcgttgaggcgcagcgtctgtttaaagacgccaatgatatgctggataaactgagcgccgagaaactgttgaatccgcgtggcgtggtgggcctgttcccggcgaaccgtgtgggtgacgacatcgaaatctatcgcgacgaaacccgtactcatgttctgacggtcagccaccacctgcgccagcagaccgagaaagttggttttgctaactactgtctggcggattttgtcgcgccgaaactgagcggcaaagcggactacatcggtgctttcgcggtgaccggcggtctgaaggaggatgcgctggcggacgccttcgaagcgcaacacgacgactataacaagatcatggtgaaagcgattgccgaccgtctggcggaagcgtttgccgagtatctgcatgagcgtgtacgtaaggtttactggggatatgcgccgaacgagagcctgagtaacgacgaattaatccgcgaaaactaccaggggattcgcccggcgccgggttatcctgcctgcccggaacataccgaaaaaggcactatctggcagctactggatgtcgaaaaacacaccgggatgaagctcaccgaatctttcgccatgtggcctggcgcgtcggtctccggctggtacttcagccatcctgagagcaaatacttcgcggtagcgcagatccaacgcgatcaggtgacagattatgctttccgtaaaggaatgagcgttgaggacgttgagcggtggctcgcgccgaacctgggttacgatgcggactgattcataaaatcgtcacttttccttacaacatacaaggcactcattgggtgccttgtctctttcttacaattaaacccttatactgaaggaaggctctacgctgaatttgccggatggcggcgtaaacgccttatccagcatgtatggtaagcctggtggcgtgcaacgccaccaggccttaacgctgtgcgccatcaggcaatttatcgcaagtgagcttcaggaaaacgtataacgataaggagaacctgacgccgtgttaactttgctccatctactttctgccgttgcgctgttggtatggggaacacatatcgttcgtactggcgtaatgcgcgtgtttggcgcgcgtctacgcactgtcctcagccgcagcgtggaaaagaaaccgctcgccttttgtgcgggtatcggtgttaccgcgctggtacaaagcagtaacgccaccactttattggtaacgtcgtttgtcgcccaggatcttgtcgccctgacgccagctctggtgattgtgctgggcgccgatgtgggtactgcgctaatggcgcgtattctcacctttgatttgtcgtggctatcgccgctgctgatttttattggcgtgattttctttttgggacgtaagcagtcccgcgccgggcagctgggtcgcgtcggtatcgggcttggcctgattctactggcgctggagctgattgtgcaggcagtgacgccgatcactcaagctaatggcgtgcaggtcattttcgcgtcgctgacgggcgacattatgctggatgcgctgattggcgcgatgttcgctattatcagttattccagcctggcggcggtgttgctgacggcgaccctgacggcggcggggattatatcgttcccggtggcgttgtgcctggtcatcggcgccaatctgggatcgggcctgttggcgatgctcaacaacagcgccgccaatgctgccgcgcgtcgcgtagcgctcggcagcctattgttcaaattgatcggcagcctggtcatcctgccgtttgtccatccgctggcgaatttgatggatgagctaccgctaccgaaatcagagctggtgatctatttccacgttttctataacctggtgcgctgcctggcgatggtgccatttgccgagctgatggcgcgtttttgtaaacgaattattcgtgatgagcctgaactggatacccatctgaagccgaaacatctggatgtcagcgcgctggatacgccaacgctggcgctggctaatgctgcccgtgaggtgttgcgcattggcgatgcgatggaacagatgatggaagggctaaaaaaggtcatgcacggcgaaccgcgtgaagagaaagcgctgcgcaagctggcggatgacgttaacgtgctctacaccgcgattaagctttatctggcgcgaatgccgaaagacgagctggcggcggaggagtcccgccggtgggcggagattattgagatggccctgaacctcgaacaggcgtcggatattatcgagcgaatgggcagtgagattgccgacaagtcgctggcggcgcgtcgggcattttcagaagaaggattgaaagagctggatgcgctttacgatcaactgctcagtaatctgcaactggcgatgtcggtctttttctccggcgatgtcaccagcgcccgtcggttgcgccgcagtaaacatcgcttccgtatacttaatcgccgatgctcacatgcgcatgtcgaccgcctgcaccagcagaacgtgcaaagtattgaaaccagctcgctccatttagggctgctgggcgatatgaagcgtcttaactcactgttctgttcggtcgcctatagcgtactggaacagccggatcaggacgaggaacggggcgagtattaagtgaaatgccggatggcggtgtaaacgtcttccggcctacggaaaacatgcgcgtaggcccgccattcggcattcaatgtggcctgggattaaaagcgatgacccgcttccagcgccacggcctcttcgcccgctttaaacacccaggtggtattcgggccgccgagaaccgcttggccgttgctcacctgaatccagttgccttccggcaaaccaatcactgtcagttccggcgcgaccaccagcagttcgcgaatatgctgctcgcgggtctcgcccttatgaccctccggcaaggcgttagtgaagtgaggattaatttgcagcgggaacagatccagcgcgtcgaaaccgtttggatcgacgatcggcatatcgttggtcgtgcggatagtcgggcaggcaaggttggcgcccgcgctccagccgatatacagcgcgccgcgttttaccctgtccgccaccggcgccagcagcccgcgttcacgcgattctttcagtagctggaaggtatttccgccgccgacaataacgatttccgctttctcaatcgccgcaagcggatcggcgacacgatgaatccctgtgacgtttatccctaatggcgcaagcacctctgcggttttatccgtgtactcgtcccatgtttgcgtgacgccggcaaacggaataaacacggctgagcgtcgaccgttcaactgattcgctatcagcggcagagcgtgttccagccaggctttacccggcagcgtcgagttacttaataaaagcagttccattatttctccacctcatcaggaaatgtcaaaacgtaataatgctaccattatccatttaatgtcttactgatatggctcatgatgttgcgcgtgttacaggcaacgcgcggtcgctaaaagtgacgccaggccagatctgccatctggtatcgcctgaaaaattacaggtataatccgcaaaattatttaacacgtttagagacgaaaatggcaaaactgaccttacaagagcaactgctacaagcgggattagtgaccagcaaaaaaatggccaaagtccaacgcacggctaaaaaatcacgcgttcaggctcgtgaggccagagaagcggtggaagaaaataaaaaggcgcaacttgagcgtgataaacaactcagtgaacagcaaaaacaagcggttttagcgaaagagtttaaagctcaggttaagcaacttattgaaatgaatagaatcaatgtatctaaaggcgatattggttttaacttcaccgataataacgtcatcaaaaaaatagacgtggataagcttacccagacacaactgattaatgggcgtctcgcgattgcgcgtctggttatcaataacagcggtgaatgtgaatatgcgattattcccgcgagcgtcgccgataaaatcgcacaacgagatgcggacagtattgtcgtaaacagtgcgctgagtcaggaagagcaggacgaagatgatccgtatgccgattttaaagttcctgacgatttgatgtggtaagtcacattcccaacgtttatgtagaaaaatttctcagagagtaaatatgctgaccgacacatctacccggcttaataaatatatcagtgaaagcggcatctgttcgcgtcgcgaggcggaccgttttatcgaacagggcaatgtctttatcaacggcaaacgcgccgccattggcgatcaggtggtcgccggggatgttgttaaagtaaatggtcggttgattgagccgcgagaagcggatgatttagtgctgattgcgctgaataaaccggttggcattgtcagtaccactgaagacggcgaacgcgacaatattgtcgattttgtgaaccacagcaaacgtatcttcccgattggtcgtctggataaagactcgcaggggctgatatttctgactaaccacggcgatctggtcaataagattctgcgtgccggtaacgatcacgaaaaagagtatctggtgacggtggataaaccgattaccgacgagtttattcgcggtatgggcgctggcgtgccgattctgggtaccgtcaccaaaaaatgtaaggtgaaaaaagaggcgccgtttgtctttcgcattaccctggtgcagggattaaaccgtcagatccgtcgtatgtgtgaatactttggttatgaagtgacgaaactggagcgtacgcgcattatgaacgtcagcctgagcgggattccgctgggcgagtggcgcgatctgacggacgatgagctgatcgatctgtttaaattgattgagggttcctcttccgaagccaaaccaaaggccaaagcgaagccgaagaccgcgggtattaagcgaccggtcgtggcgatcgaaaaaagcaatgagaaagcgcgcccggcatcaagcggtaagcgctttacctcgccgggacgaaagaagaaaggacgttaacgtctgccgcgcgtcggcgtattcgccgaccaggagaatgacgcttccgtatcgggtttatacgcctgctttttcttcaactggcgggcttttttcgcttcagcctcacgcagcgccatcagcttatcgatgtactccttttttacgctgttggtctcagaattggtcagcggacgcccgtgcgcaatacgggcgcggtccagcaacgttttcagttcgcgctgttcgcgctcggtcatctctttttgggtaatgcgggggagtgccatacgggtgccctcagttagccgatgcatttagtctacggcaatacgcaacgggcggatagcgctcagtcagcaatccgcagctttccagcgaaatcctgtggcgtataacccgttgacgtaaatcctttatccgtgatgatgttatcgatttcttttacgcttgcgatgcacatcacaccgtcctgaccaaatttggtatggtcagcgagaatcactgattttttgctcatcgcaatcatggctttggcaacgtaggcttcttcaaagctcttcaccaacacgccatgctggggagaaatgccgccagcgccaataaaacagatatccgcgtgaatcgcgttaatctgctgacataccgagacgccgagattagcgcgaaaatggtaatcatattcgccgcctaatacatacacgcgggcctgcaggttatgctctttaattttatcggcaatcagtgctgaattggtaatcacggaaaaagcgagaggcggtaattgctcggccagaataaggttagttgtacaggaatcaataaacaatgtatcccgttcactgatcatttcggcggcaagtttgccaatcgctattttctcttcgcgatgcgcctctattcttgcgctaaacgcatcttcctggacaacttgctttttgaccgcgcccccatgaatcttagtgattttgccttctgattccagtaaggagagatcgcgacgaatggtttccgaggtgacgttgagcatttccgataatttaataacggtgacttcaccgaatttgtttaattcatcaagaatatgttttcgtcttttaattggattcattatctttcgccgctgtcaacctttggcgcatggtaactggatgcgtaaggcaacgcaaccactccaacgcatggacgataccctcctcatcattcgtggcagtcacatagtcggcctgccgctttactgcatccggcgcgttgcccattgcgatgctgattccggcggcggcaaacatgctgacatcattctgctgatcgccaatcacgaccaccttgtcagaagatatatttaaataatgaattaattgttctattatgcaccctttatttacatcggttctttgaatatcaatataattttctcccgtgacgaccgcataatatccataaggcaggtgattattcacttctgtacacagtgtatctatctccgaagatacggcaacaagggtaattttatatatatcgcgacgattaaagatattttctgtagtttcagttataagcggcaacccaaataagcgggcttcatatgttgtccagggcgcaatcagtctatcgtcacgatggtgaattgcttcggcgctaaaaaaatggtggtgatagcgggaaagagaaatatgctggtcaatattccacagatctgtggcggacaacggagcagcatgaataatgcgctgccccgccatctccagaagatgtccgcagttaaaaccggcgcaccagctaaacaacctatcaacctgttgttggtgtagcaggcgtaccattgaggagaccggtctggcggaacatgccgccagcagactaccgtcctggcggaacgcaatcagcgcctgacgcgtgcgcgggctgattgttttctgcgaggtgagtaatgttccatccagatcggtgattaacaacatctctcgttccctgatatcaatgaacaataaacggcgtaacggcttctttggcggcgttgcacaccatgttgtcgatagccgtaccgaccaccagaatattgactccggtatctttaaacgctttcgcgttggcgaggttaatcccgccttccgccagcgtcggaacatccaccgcgccgaccaacgcccgcaggcgatctttaatcatctgcgggatatcgcctgccgctacgccttcatagctcatgcctgtcatcagaccaatcatatccacgccgatatcctgcatccgcttcgccacgctggcgacctcttccggcgtgcgtgcaggaataccgaaagtatgcagatcgtcaggatggccaatgtaggcatcgacggtcagaccatattgatgggcgagattaacgatgtcctgcagatcgtcccagtcggatttatgcgtatgtaaaccgtcggctccagcgcgggcaatctccagaatttccgtttcgctgagcggcaccggtaaggtttcggtaaaaccgccggcgataccaacggtgataaaaatatcgtccgggaccacattacgaacaccgtgtacggcctcagccatctggctattggtgatttcgtgacgaatctgctccgccgcgtgcatgttgctcacgcctttgtgtccacgcgccagcgccaacgcagggtggttcggctccagaagcttaacgccagcctcacacacggctttcgccaggcgcgcatcgtcgccagttattcctgtgctgaggatagtttgcccaccgtgaagcgtgatggcttctttcactttctgtaacgctttggcgcgttttttattcatatcgcctttaaacatggtgtacctctggtgttggtgcattaattaacggctgtcgttgttgattcgctctgtacgacaggtttgaaacggttagcaataatggtggtaaggcaggtcatcgccattgtggcaatcattacgatggccatctggagcgcattgctggataagaacggtgaggcgaaagccggaacataggccacgcctttgacgttaaaaaagcccagcatcatgccgcccattccggcccaaaaaatggcggagccaaaaacaattttgttggcgaacatgaagggataggcggattcaacaaaggtgccaaaacccaggttaatgagcaggcccggcgtagcaacggcagcttcgcttttttcacgcggggcgatcacattggcaaggttaatacctgcggccaccatcaccagaccgaccatatcgaccgcgccgaggaagctgacgccggatttttccatctccagcagtaccaacggcaggatcaccgcgtgatagacgccgccgagaatggcaggccagataaccagaccagccagcagcccggcaagaattgggctgaatgccagcgtgctttcgatagccagtttgatgtaattacccgcagatagcgccagcggactcagcagatagtgcatgattaacccagcggcaaggcccgatatcccaccggcgacgatgttgacggtagtcattgggaagcgccagttcaggcacagctcgaacagccaacggacgaaaatccccgccattacaccgccgataatgccgccgatcagtccgccctctacggaaagcacgccagcgacgaccccagccacaattgaaacttcatccagttcggaaatctgttttgccgccagtaccgcgactaacactggcagaccttttagtaatatttcaaagatatcgttaagtttttccagtcctggtatgtggctcagggcgagtacaatcgccatggcgataaagcctggtagcgcagggatcatgatgctacgaatgttaaaacgtttgagcaggctttttccggaaccgctctgcgagggcgaagcgctacccaactgtggtttgtacttgataccccaatgtttacatagtgacgccacgaaggagacggcgcgggtacggctggtggtgccggttgttccggaggtcgcgaccacattcgccccctttgccgccaccagcgccatggaggttcccccggtgccgacaatcggtgttttcatctcaacggcggcggcaaaaatggcttggttcgcctttaccggatcggcgctcattaccacgatcccatcgatctcaccgcggcggatcatctcagcgatttggcgatcgctttctactaccgaggtgtttacctccgaaagcttaccctgaaatatgcgctgtggtttttgttggttttctgtggttaatgcataaaccgatgccggggtgtccggtttggcgacgtccatcgaggcctctgccgcgataaattgtacggcggccacattcacgcccgcagcctcacactgctgataaatctcctggagtaacttctctggctcggcgccacccaggttgtagaggttgcctccactgcttccaataatcgcaattttttcatagcggcctcaaatagggtaagggggttatctgtgttgtagtgcaatcataattccaactaaaacaaaataaagcaacaatgaaaaagtgcttttataccaaacgatctcaatttttaaaggtaagttattaaaatataatgataaatttatgtttttgttttgtgttgttttgcgtggttttgtgacgaggttcaaaatgaggagggcataaataggggaaagctgcccatattgatgggacgagcagggtgtacagattcctgccttctgtaattggctttctggagcagtattccgccggcagtgcctgacgtgggaaccgccggataaggcgcttgcgtcgccatccggcagcgtattgcctgatagcgctcacccgctgtcgtgtcagggcgattattcaaataagttctgatgtagcttttgcaccactttctcggcatcgtctcccggcacgaggaagcacagattgtggctggaggcgccgtaacaaatcatgcgaatgttgaacggttccaggacgccaaacacttctttaccaacaccgcaggcttttgacaggttgttgccaatcagcgcgaccagcgccagtccttcttcaacttcgacccgacacagcgcggaaagctccatcaataaggattgggtcagtaacgtatcgcccgtggaggtggagccggtagtatccagcgtcagcgcgacgctcacctccgaagtggtaatcagatctaccgaaatattatgccgcgccagaatgccgaacacctctgccaggaaacctcgtgagtgcagcatattcaggctgtgcagcgtcaatagcgtttgattgcggcgcagcgccagcgcgcggaacagcggcgggttttgggttttattgcacaccagcgtaccgcccgcttgcggatctttactggagccaacgaagaccgggatatcgctgcgcacggccgggagtaaggtggctggatgcagtacttttgcgccgaaggttgccatctccgccgcttcttcaaagtcgatttcatcaattcgctgcgcgacgggcactacgcgcgggtcggtggtgtaaataccgggcacatctgtccagatatcaacccgcgcggcgtggagcgcttcagccagcaacgctgccgtatagtcgctgccgccgcggcctaatgtcgtggtgcggcctttgctttcactgccgataaagccctgagtaatgaccaacgtttcgctcaggcgcgggagcaactgctgcgcggccagttccgcaagcgctgcgacgtccggttccgcacgaccaaagcgatcgctggtacgcatcactttgcgcacgtcgaaccagtgggcctgtacgtcgcgttcacgcaggatctcaacaaatagcagggtagacattagctcgccgtggctgaccagttcatcggtcagggctgccgatgtcgccagcgatgccgcctccgccagaatagtgatgttttccagcaggcgttcaatctcttcgcgaatgacattcggatgacgcagacgatcaaggatatcgaactggattttacggatggcgtcgagcgtagcgaaacgttcgccgggctccatcccttcggccagcgccaccagcagattagtgatgccggcagacgcggaaagcacgactaaacgaacattggcgtcggaaagtacgatatccgcgctacggttcatggcgtcaaaatcagcgacgctggtaccgccaaatttggaaacaacgatctctgtcatatcaacctcgtgtcaggaaatgaaaaacgcgaccatggcacaaaggcagaacagaaaccggtgcaggcgcaaatgcaagtaacgtatttataaataaaagttgtggactggactgtcaacgttgggattatgcggattttttatgctgagtttaggctcagtaacagcgcttataaccccgatacccgtttgtaggaatgttggcttatctatgcgcccggcgactcacccacttgccgcctttctgcacctcgaattatttagggtatatactttttatcctcattcgacagtgcctggggcaacggcactaaaacaatcacacttttctgtgactggcgttacaatcgatcccagtcacaattctcaaatcagaagagtattgctaatgaaaaacatcaatccaacgcagacttctgcctggcaggcgctccagaaacactacgacgaaatgaaagacgttacgatcgctgagcttttcgcgaacgatagcgaccgtttcgctaaattttccgcgacgtttgacgatctgatgctggtggacttctccaaaaaccgcatcaccgaagagacgctggcaaaattacaggatctggcgaaagagaccgatctggccggcgcgattaaatccatgttctccggcgagaagatcaaccgcaccgaagaccgcgccgtgctgcacgtggcgctgcgtaaccgtagcaatacgccgatcattgtggacggcaaagatgtgatgccggaagtgaacgccgtgcttgagaaaatgaaaactttctcgcaagcgattatctccggtcagtggaaaggctacaccggtaaggccatcaccgacgtggtgaacatcggtatcggcggttccgacctcggcccgttcatggtgaccgaagcgctgcgtccgtataaaaatcatctgactatgcacttcgtctctaacgttgatggtacccacatcgctgaagtgctgaaaaaagtgaacccggaaacgactctgttcctggtggcgtcgaaaaccttcaccacgcaggaaaccatgaccaacgcccacagcgcgcgcgactggttcctgaaaagtgcaggcgatgaaaaacacgtggcgaaacactttgctgcgctctccaccaacgccaaagcggtcggcgaatttggtatcgacacggccaatatgttcgagttctgggactgggtcggcggtcgttactcgctgtggtctgccatcggactgtccattattctgtccgtcggtttcgacaactttgtcgagctgctttccggcgcgcacgcgatggacaagcatttctccaccactccggcggagaaaaacctacccattctgctggcgttgattggcatctggtacaacaatttcttcggcgcggaaaccgaagccattctgccgtacgaccagtatatgcaccgtttcgccgcctacttccagcagggcaacatggaatccaacggtaaatacgttgaccgtaacggcaacgccgtggattaccagacaggcccaattatctggggcgaaccaggcaccaacggtcagcacgcgttttatcaattgattcaccagggtactaaaatggtgccgtgtgactttatcgccccggctatcacccataacccgctatccgatcatcatcagaagctgctgtctaacttcttcgcgcagaccgaagcgctggcgtttggtaaatcccgcgaggtggttgagcaggaatatcgcgatcagggtaaagatccggcgcagcttgaacacgttgtgccattcaaagtgtttgaaggcaaccgcccgaccaactctatactgctgcgcgaaattacgccgttcagcctgggcgcgctgattgcgttgtatgagcataaaatctttacgcagggcgtcatcctgaacatctttactttcgaccagtggggcgttgagttgggtaaacagttggctaaccgtattctgccggagctgggcgatgataaagctatttcgtcccatgatagctctactaacggtctgattaaccgttataaagcctggcgcgcctgatggcgctgcgcttatccggtctacgtaatgcatagcgtctgtaggccggataaggcatttcgccgccatccggcaaaaagagaataagataataaaaaggccgatattcacatcggctttttttataagataattccgcttgtccgtctttatccccacaattttatattgagcttaatcctaaaataagcaataaccagaaaatcactctgcgttattttcagattatacggatgctgatgtcttttagtttaattttaacttatttattttatttgttttttaattaaataatataggcgttacttctttaaagtttaattatcctaaaacctcgctgttatttctcccggacataatccgcctgctttggttgtgtatactcggtagcgcccgaaattcttttgggtaaatctccattcattcaatgaagggaaattatgatgaaaaaagtactgtatggcatttttgccataaccgcgcttgcggcgacatctgtctcggcagcccccgttcaggtgggtgaagcggcagggtcggcagcgacgtcggtatcggcgggaagctcctccgctaccagcgttagcaccgtaagttcggcggtgggcgtcgcgttagcggtaaccggcggcggcgatggttccaataccggaaccacgaccaccacgaccaccagtacccagtagtatcggtacgtttaaccataaccacactccggtgtggttattttgcccctctggagaagcgtcgtgaagcgactcgcacttatcctgatttgcctgctattacaggcgtgttcggccaccaccaaaggcctgggcgattcactgtgggacagtttgttcggtacgccaggcgtacagctaacggatgacgatattcaaaacatgccttatgccagccagtacatgcagcttaacggcggtcctcaactgtttgtggtgctcgctttctcggaaaacgggcagcagaaatgggtgacgcaggatggcgcgacgatcgtgacgcagcatggccgtctggtcaaaacgctgctcggcggcgacaacctgatcgatgtgaataatctggcgaccgacccgctggcgaaaccaggacagattatcgatggcgcgacctggactcgcaccctgggctggaccgaacatcgccaggtgcgttacgccaccgcccgttccgtttttacatggcgagggaccgatagagtgaacgtcggcagtgaggaaaccgccgtgcgggtgttagatgaagaagtgacgaccgatcaaacgcgctggcgtaatcgctactgggttgatagcgaaggccaaattcgccagacggaacagtatctgggcgcgaattactttccggtgaaaaccacgctgattaaggcggcaaaatcatgatgaaaaggacgataagcgcgctggcgctggcctttgtcgcgtcatccgcctttgccagcggcactgttaccgtttttacccagggtaatagcgagcctaaaacgctgacagacgctgagcgtctgctcgatttagtcggacagccgcgcctggcaacgagctggtggcctgcggcggtgataggcgaagaacaggcgaccgtgacggcgcgtcagcagcagcaggaacttctcgggcgactggcggcgctcagcgctgaggaagatggcgatgcggcggcgataaacacactacgccgacagattcaggcggtgaaggtgacgggcagacaattcgtgaatcttgatcctgacgtggtgcgggtgagcgaacgaggtaacccgccgctgcaaggtcactacacgctctgggtcgggccgcaacccacgcaggtgacgctctttggcttgattagccagccgggcagccagccgttcgtccctgggcgggacgtcgccagttatcttgaggggcagcgcttactcagcggcgcggatcgtagctatgcctgggtggtttaccctgatggacgcagccaaaaagcgccggtggcttactggaataaacgtcatatcgagccgatgcccggcagcatcatttttgtcggttttgccgattccctttggcgcggcacgccggaggcgataaatgccgacattcttcataccctgacgcagcggataccggaataatgaaaaaaacacatctgctcagcgtgctggcgctgggtattagcgcggcctgccatgccgaaacatatccagcccctgttgggccttcacaatctgactttggcggcgtgggcctgctgcaaacgccgacagcgcgtatggcgcgtgaaggggagatgagcctgaactatcgcgataacgatcagtaccgctactactcggcttcggttcagcttttcccgtggctggaaaccacgttgcgctataccgatgtccgtacgaaaaagtacagcagcgtggaatcattctccggcgaccagacttacaaagataaagcgtttgatgtgaaactgcggttgtgggaagagagttactggatgccgcaggtggcggttggcgcgcgcgatatcggcgggacggggctgtttgatgcggaatatattgtagcgagtaaggcttgggggccatttgatttttcattaggtctcggctggggctatcttggcaccagcggcaatgtgtctaatcctttctgttcgtatagtgataaattctgttcgcgtgataacagctataaagaggccggttccgtcgacggtagcgatatgtttcacggcccggcttcgctgtttggcggcgtggaataccagaccccgtggcaaccgctacgcctgaagctggagtatgaaggcaataactatcagcaggattttgcggggaaactggaacagaagagcaagtttaacgtcggcgccatttactgcgtcaccgattgggccgacgttaacctcagctacgagcgcggcaacacctttatgtttggcgttacgctgcgcaccaatttcaacgatttacgtcccgcgtatcatgacaattcacgcccgcaataccgaccacagccgcaggatgccatcctgcaacattcggtagtggctaatcaattaacgttattgaaatataatgccggtctggcggacccgaaaatccaggtcaaaggcgatacgctatacgttaccggtgaacaggtgaagtaccgcgactcccgtgaggggatcgtgcgcgctaaccggatcgtcatgaacgatctgccggaggggatccgcacgatccgcgtgacggaaaaccgccttaatctgccgcaggtcaccactgaaaccgatgtcgccagcctgaaacgccatctggaaggcgaaccgctgggacatgaaactccgctggcgcaaaaacgcgtggagccgatcgtgccagagagtactgaacagggttggtatatcgacaagtcgcgcattgattttcatcttgatcccgtgctgaatcagtcggtaggcggcccggaaaacttctatatgtatcagttgggcgtaatgggaactgcggatctgtgggtcacggatcatctgctcaccacgggcagcgtgtttgccaatatcgccaacaactacgacaaatttaactacaccaatccaccgaaggactcgcatctgccgcgggtgcgtacgcatgtccgtgagtatgtgcagaatgatgtttatgtgaataacctacaggccaactacttccagtattttggcaatggtttctatgggcaggtctatggcggttatctggagaccatgtttggcggtgccggggcggaagtcctgtatcgcccggtagacagcaattgggcgtttggtctggatgccaactacgtgaaacagcgtgactggcgtagcgcgcaggatatgatgaagtttaccgattacagcgtgaagaccggacatttgaccgcatactggacgccgtcgttcgcccaggatgtgctggtgaaagccagcgttggtcagtatctggcgggcgataaaggcggtacgctggagatcgccaaacgcttcgatagcggcgtcgttgtcggcggttacgcgacgattaccgatgcgtcgccggatgaatatggggaaggggattttaccaaaggcgtatatgtttccgtaccgctggatctcttctcgtccggcccaacccgaagtcgtgcggcaattggctggacgccgctgacgcgtgacggtggtcaacagcttggccgtaagtttggcctgtatgatatgaccagtgacaggagcgtaaatttccgttaatactcaggccggataaggcgttcacggcgctatccggcaaattaccttattgaacaaaatataaacacaaataaaaaatatagatgcccgtcacatttgtgcgttatacagaaacctcgccgcagagaaagagggggctgttatgatgccattatcgcgctcacgtcttgagtttatcgccacgattttacaaaacgtactaaatttggggctgcttaccctcggtctgatcctggtcgtttttctcggtaaagagacggtgcatctggcggacgcattattcgcgcctgagcaagccagcaaatatgaactggtggaagggctggtgatctactttctttatttcgaatttattgcgctgattgtgaagtactttaagtctggccttcactttccgctgcgctatttcgtgtacattgggatcacggcgattgtgcgtctgatcattgtcgatcataaaacgccaatggatgtattactctattcggcggcgatcctcctgttggttatcacgttgtggttatgtaattcgaaccgactacggcgagaataggcgtcgccacaccgtaacggacgtatggcgtggcaataaattagccgctgtctataacgcataaaaaaagcgctccgaagagcgccaaaatacgaccataagtggggataacataacttgagggcagtggcattgcccgttgccgggcaggtacttcgataaaacttaacctttcacaccccctgccgtcaggccgttgaccagccaacgttgcgccaacaggaacaccagggtgataggaatagctgaaaggacggcggcggcggcaaagtcgccccacaaatagttttgcgggttgagatattgctgcatacccacggccagcgtatagctgtccacatcgcgcagtaacaacgaggcgaccggaacttcggtaatcgccgcgatgaacgacagaataaacaccaccgccagaatcggtacggaaagcggcagcagcaccagacgaaatgcctgccacggggttgcgccatccagcgcggcggcctcttccagcgagctgtcgatagtttcgaagtagcctttaattgtccagacgtgcagcgcgatgccgccaagataggcgaagatcacgccgccatgcgtattcagaccgataaatggaatgtattgtcccaggcggtcaaataacgcatacagcgccaccagagacaaaaccgccggaaacatctggaaaatcagcatccctttgagcagtgttgctttacctggaaaacgcattcgtgcgaaagcgtaggcgcaggtggtggagagcgccacgatgccgatggcggtaataccggcgattttcaccgagttccacagccacagcaggaccgggaagggaggcggcgttacccgaccatccgcatgttccacgctgaaacccagcgccagccgccagtgttcccaggagattttatccgggatcaggcttccggtggcgaagttcccttcacgtagcgagatagcgatgaccatcagcagcgggaacataatcgccgcgatgaaaatcagcagccccaggtgcgtgatgaagagacgcagtttctgagatttgggttggaccatagccattgttattatctcccttaatcaaacttcatacgcgtggctttcaggttcactattgccagcgcgcctaccagcaggaagatcagcgtggcaatggccgccgccagaccgaagtcctgaccgccgccgccttcaaaggcgatacggtaggtgtagctgacgagcagatcggtataaccggcaggcgtggtggtgccgagacggtctggcccgccgttggtcaataactgaatcaggacaaagttattaaagttaaaggcgaagctggcgatcatcagcggcgttagcggcttaatcagcagcggtaaggtgattttaaagaaattctgaaatggaccagcgccgtccattgcggaggcttcgtacaggtcatccggaatcgctttcagcagtcccatgcacaggatcatcatgtagggatagcccagccaggtattcacgataatcaccattgcccgcgcggtgttggggtcgctgaaccaggcaggtttaatgccaaacagcgcgctcagcatcatattgatttcgccaaagctttggttgaataaccctttgaaaatcaaaattgaaataaacgacggtacggcgtagggcagaatcagcaggacgcggtagatagctttacctttcagcgcttcccactgtacgaggcaggccaataccatcccaaccgccacggttaacaccacagtgaggaccgaaaagaccacggtccagacgaagatagcgaaaaaaggcttctggatcccttcgtcggtaaagacgcgcgtaaagtttttcgcgccgatagtaacggtataaccaggactgagtttttcatcaccccagcttccgtcggcgttgatcgactgataataaccgctatcgttgtttggccggtattttacgccgctctggttattggtaagcaggccgtcatcagccagtgtgtacagcggacgggtaccggaaaactgacgcagcgagctcataaccactttactttcatccggcaggacggcggttatctggttcagcgccagacggttctgggtgattatccgcagattggcgcgttcgccgcccggcagggcatcggtctctttcagctgtaatttttgttcgccgccgaaggaaaatgcgccagacaggtaatgtttgcccgtttctccgtcggtgagggccagttgccactcgtcgccggccgggtaaagaccgaagttataggtttttcccgcctgataagaacggtccatcagcacttgctgggcgcgttcaaaggtgagctggttggtgctgctgtagttagtaaaggcgatggcgatggtgcacaccagcgggaatagcacaaacagccccatgccggcgaggccagggtaaacgtagcgccaggcataggttttacgatttgcgaaaatatacaggccagcagagcttaaaatcagcgtcatgatggcgaacagatactccccttgtacgtacattaaaactacaaggtaacccaccagcaggcccagcagaccaattactgaccatttaagctggtcgctttgccaccagtgtttctttttaatgacatccatgggggttttcctctacagcgttgaaacttcctggccggagatgtgcctgatggcgctgcgcttatcaggcctacggtgtgttgtaggccggataaggcatttatgtcgccatccggcacaggctcgcggcattacttggtgatacggctttgtgcatctttcagcgcggcatccacggtttgacggccgctggcggcgttaatcacagccgtacgtaccgcataccagaaggcggacatctgcggaatattcggcatgatctcgcctttctgggcgttatccatggtggcggcgatacgggggtctttcgctaactgctcctggaaagatttcagcgccacggcgcccagcggtttgtctttgttcaccgcctccagaccctgatcggtcagcaggtagttttcgaggaactctttcgccagctctttattcgggctggcagcgttaatccccgcgctcagcacgccgacgaacggtttcgagggtttacctttgaaggtcggcagcagggtgacaccgtagttgactttgctcttgtcgatgttcgaccatgcccacggaccgttgatggtcattgccgtttcgcctttattgaaggctgcttcggcgatggagtaatcggtatcggcgctcatatttttgttcttgatcatatcgatcaggaaagtcagacctgctttcgcgccggcgttgtcgacgccaacgtctttcacgtcatacttgccgttttcaaatttgaacgcgtaaccgccgtcagcggcgatcaaaggccaggtgaaatacggctcttgcaggttgaacattatcgccgacttccctttcgcttttagctctttatccagcgccgggatctcttcccaggttttcggcgggttcgggacgaggtctttgttataaatcagggagagggcttcaacggcgatggggtaggcgatcagcttgccgttataacgtaccgcatcccaggtaaacggatagagtttgtcctgaaacgctttatccggagtaacctccgccagcagaccagactgcgcgtagccgccaaaacggtcgtgcgcccagaagataatgtcaggaccgtcgccggtggcagccacctgcgggaatttctcttccagcttatccgggtgctcaacggtcactttaatgccggtgtcttgctcaaattttttaccgacctcggccagaccgttatagcccttgtcgccgttgatccagataaccagtttaccttcttcaattttggcgagagccggggcggaaatcatcatcgtcgtaagtgcggataatgcgaggatgcctacgccagttttaatcttcatatctcccatcctttttggtgatgtacacagaggtggtttaacggtctctagtttctttatacgacaacctctttccatcctccctacccctacgccccaccccggctttatgtgatctgtgttgcataaatgtgagtaatgcgtgctggcgcacacaaaaacacgccgatttttgcgggcggcatcacgaaattccttttctgtccgcgcccgtggtctcaggcgttgtgtcctcatcctcccgcctcctcccccataaaaaagccggggggtggaggatttaccccagtcagggatcgcgcatagtcaggccatcatgaatgttgctgtcaatgacaggttgtaacgaagggagaagggcatggcgagcgtacagctacgaaatgtaacgaaagcctggggtgacgtggtggtatcgaaagatattaacctcgatatccatgacggggagttcgtggtgtttgtcggaccgtcaggctgtggtaaatcgaccttgctgcgtatgatcgccgggcttgaaactatcaccagtggcgacctgtttatcggggaaacccgtatgaatgatattccgcctgccgagcgcggcgtgggcatggtattccagtcttatgcgctctatccccatctctccgttgcagaaaacatgtctttcggcctcaagctggcgggcgccaaaaaagaggtaatgaatcaacgcgtcaatcaggtggcggaagtactgcaactggcgcatctgctggaacgtaagccaaaagcgctttccggcggtcagcgtcagcgcgtagcgattggccgcacgctggtggcggagccgcgtgtgtttttgctggatgaaccgctctctaacctggatgccgcgctacgcgtgcagatgcgcattgaaatttctcgcctgcataaacgtctgggccgcacgatgatttacgtcacccacgatcaggtcgaggcgatgacgctggccgacaaaatcgtggtgctggacgctggtcgcgtcgcgcaggtcggtaagccgctggagctgtaccactatccggcggaccgctttgtcgcgggctttatcggctcgccgaagatgaacttcctgccggtgaaagtgaccgccaccgcaattgaacaagtccaggtcgaactgccgaatcgccagcaaatctggctgccggtcgaaagtcgcggcgtgcaggtcggcgccaatatgtctttaggcattcggccggaacacctgctgccgagcgatatcgccgatgtcaccctggaaggtgaagtccaggtggtcgagcagttagggcacgaaacacaaattcatatccagatccccgccatccgtcaaaacctggtttatcgccagaatgacgtggtgctggtagaagagggcgccacattcgctatcggcctgccgccagagcgctgtcatctgttccgcgaggatggcagcgcatgtcgtcgtctgcatcaagagccgggtgtttaaggcctccataaaaaaacgaaacgcaaaaccattcgcagttttagaaggtggcagcgtttaaagaaaagcaatgatctcaggagtatagaatgatgattactctgcgcaaactccctctggcggttgctgtcgcagcgggcgtaatgtccgctcaggcaatggctgtcgatttccacggttacgcccgttccggtattggctggacgggaagcggcggcgaacaacaatgtttccaggtgaccggtgcacaaagtaaataccgtctcggtaacgaatgtgaaacctatgcggaactgaaactgggccaggaagtgtggaaagagggcgataagagcttctatttcgacaccaacgtcgcctattcggttaaccagcagaacgactgggaatcgaccgatcccgccttccgcgaagcgaacgtgcagggtaaaaacctgattgaatggctgccgggctctaccatctgggccggtaagcgcttctatcagcgtcatgacgtacacatgatcgacttctactactgggatatttcaggtcctggcgcaggtatcgaaaatatcgatctgggcttcggtaagctttcgctggcggcgacccggtctactgaagcgggcggctcttacaccttcagcagccagaatatttatgatgaagtaaaagataccgctaacgacgtctttgacgtacgtctggctggtctgcaaacgaacccggacggcgtactggagttgggcgttgactacggtcgcgccaatacgaccgatggttataagctggctgatggggcatcgaaagacggctggatgttcaccgccgaacacacgcaaagcatgttgaaaggctataacaagtttgtcgtgcaatatgccaccgatgccatgaccacgcagggtaaaggccaggcgcgcggttccgacggttcttcatctttcactgaagaattgcctgatggaaccaaaattaattatgccaataaggtcatcaataataatggcgatatgtggcgtattttggatcatggcgccatctcgcttggtgataaatgggatttgatgtacgtcggtatgtaccagaatatcgattgggataataacctgggtactgagtggtggaccgtgggcgtacgtccaatgtacaagtggacgccaatcatgagtaccctgctggaagtcggctacgacaacgtgaaatctcagcagaccggcgatcgtaacaatcaatataaaatcaccctggcgcaacagtggcaggcgggcgacagcatctggtcgcgtccggctatccgtattttcgccacctacgcgaaatgggatgagaaatggggctatatcaaagacggcgataacatttcccgttatgccgcagcgactaactccggcatttccaccaacagccgtggcgatagcgatgagtggaccttcggcgcccagatggaaatctggtggtaatacgatggtcatctgacgtaacgaggggcgcaagcccctctgaaacatcaggtctgatgatgcttgtaagccgaataaggcgccagccgccattcggcgatatgtttgggttggcgcgctattgcctggctaccgctgaacccgccttattgaggtgagaataatgaaaatgaagaaaagtctcgtcgccctctgtttaaccgcagggctgttcgccagcgtgccgggtatcagcctggcggaagtgaactatgtaccgcaaaataccagtgccgcgcccgctattcctgctgctgcgctacagcaattaacctggacgcctgtagatcagtcaaaaacgcagtctacccaactggcgacgggcggccagcgccttgacgtcgccggcattaccggcccggtcgccgcttatagcgttccggcgaatatcggcgagctgacattaactctgaccagcgaggtcaataagcaagccagcgtttttgcgccaaacgtgttgattcttgaccaaaatatgacgccttcggcgttcttccccagcagttactttacttatcagcagccgggcgtcatgagcgcagatcggctggaaggcgtgatgcgcctgacgcctgcgttggggcagcagaaactctatgttctggtgtttacgaccgaaaaagatcttcagcaaactactacgctgctcgatccggcaaaagcctatgccaaaggcgtcggtaactctatcccggatattcccgatccagttgctcgccataccactgatggcgtggtgaaactgaaggtgaaaaccaacagtagctccagcgtattggtcgggccgttgtttggctcgtccggtaccgggccggtaacggtaggcaataccgccgcgccggtcgctgcgccagcgccagtcgcgccgaagaaaagcgaaccgatgttgaacgatacggaaagctattttaataaagcgattaaggatgccgtagcgaaaggcgacgtcgataaagcgctgaaactgcttgatgaggccgaacgtctgggatcgacatctgcccgttccacctttatcagcagtgtaaaaggcaaggggtaattgtttccccacagtgctgattttgcagcaactggtgcgtctcctggcgcacctttttttgtcatttcatgcgaattgttatttttttgttgcgcaacagatcacttaattgtgattgcgccccccgtaatgtcttttctgagatacaatgactttaggttatgaatcggagagtaaggcatgtcacaccctgcgttaacgcaactgcgtgcgctgcgctattttgatgcgattcctgcgcttgaaccccatttgctggactggctgttgctggaagattctgtgactaaacgttttgagcagcagggaaagcgggtaagcgtgacgctgattcgggaagcgtttgtcggccaaagtgaggtcgaggaagcatcaggtttactgccatccgagtcccgctactggttacgtgagatactgctttgcgctgacggcgagccctggcttgccggacgtaccgtggtaccggaatccacgctgtgcggacctgaacaggtcttacaacatctgggtaaaaccccgcttggacgttatctatttacatcatcgacactgacccgcgattttattgaaattggacgcgatgcaacgctgtgggggcgccgctctcgactgcggttgagcggaaaaccgctgttgcttaccgagctttttttacctgcatcgccgctgtactgagaggaagataaagatggagtggagtctgacgcagagtaagctgctggcgtttcaccgtttgatgcgtacagataagcctattggcgcgttgctgctgctctggccgacgctttgggcgctatgggtggcgacgccgggtatgcctcagctgtggattttggcagtttttgtcgctggcgtgtggttaatgcgcgcggcgggctgcgtggtgaatgattatgccgatcgtaaatttgacggacatgtaaaacgtacggtcaaccgacctttacccagcggcgccgtgacagagaaagaagcgcgcaacctgtttgtggtgctggtgctgctggcgtttctgttggtgctgacgctgaacgccatgacgattctgctttccgtggcggcgctggcgttggcctgggtttatccctttatgaaacgctacacccacctgccgcaggtcgtgctgggggccgctttcggctggtcaatccccatggcgttcgccgcggtgagcgaatccctgccgttgagctgctggctgatgttcctcgccaatattctctgggcggtggcttacgatacgcaatatgcgatggtcgacagagatgatgatatcaagataggcattaaatcgactgcgatcttgtttggtcgttatgacacattgattatcgggattctgcagcttggcgtcatggcgttaatggcgctgatcggctggttgaatggtctgggatggggatattactgggctgtgctggtggcgggcgcgctgtttgtctaccagcaaaaactgattgcgaaccgtgaacgtgaagcctgctttaaagcctttatgaacaataactacgttggcctggtgctatttttagggctggcgatgagttactggcacttctgatgtcatgccgggcgaacccggcctacaaagccaaaattttcaatacgtcatatcagttgcccgatgagcttgcactatcgggcatttcaggcactggcttactcgccctgcgtcgcgctttcaatcgtcagacggacatcagaggtaattagatcggcaagcatctgatatatcttcatcgtttctgccggttcggcatcgcccgtatcactgatataaccctcatcccgtagcgtcaacacgagtgaactgaacaccgctttgtcgaaaaactccggcgcgttaataccgtgcaggacagacagacgttgcgccacggtacggctttctttctccagcgtactgcggttgatggacggattggcgctcaatagccagaacgtaatggcataacgctgtagcgtttcacgcgcgcctgccgccagcagttgcagcgtacgggaatgcgtcgggttgatatgcagttcatcatcctgcagggtaattagcccctgacgctgcatttcactggccagcgcgtcgatgaccgaggctaactcctcgcgctcccagcgcaggaacagctccgcttttaacatcggatagagcgcttcaacatgctgctgcaacgcatcacgcgaaatgcgacgatgctgggtgataatcgccgccatcagcgaaggcataatcaacatatgcgcgatattgttacgataataggtcatcaacaccgcctgctcgcgcggcaggatgatgatatcgccaatggtgtctttctcgacctcaaacttattcatctgcagcgcgtgagcgatgagctcgccagcgctggcggcaggaaccgttgagtctgtggaataagggacattgcgcatcagatcgagatagcagtcaagctgctcggtgagctgctcgcgggtgagcgagcgctgacgcgacgctaacagcgcggtacaacacaggttcatcgcgtttgccgcgccagcgttgttaatacgcaccatcagatcggcggcaatactatttaccgtcggcgtcagccaggctgggcgtatggcctctatagggtcgatagattcgcgccactctggcacatgctggttcaggtacgtcatgagcggcatcggttcgccaaagttaacgtagccctgacccagattgcgcagcttgctcaagcctttcagcatctgcggcagactctctttctcttttgtcgcgccgcgcagctctttcgcataggtgcccacttccatgacgtgctcatagccaatgtagatcggtacgagggtaattgggcgggtaccgccgcgtagcatcgcctggatagtcatcgacagggtgccggttttcggatctaacaaacgtccggtacgcgaacgtcctccttcgacaaaatactcaaccgagtaaccgcggctgaacagctcgcccaggtattcgcgaaagacggtggaatagagtttattccccttaaaggtgcgacgaataaagaacgcgcccagacgacggaaaattgggccagcgggccagaaattaaggttaataccggcggcaatgtgcggcggaaccagcccctgatggtacagcacataagaaaggagcaagtagtccatatggctgcggtgacagggtacatagacgatttcatgcccgtcgtgcgccagttggcgtacgcgctcggcgttatgcacgttaatcccctggtaaagtcggttccaggtaaaccccaaaatcctgtcggtcaaacgaatcatctcgtaagagaagttcgccgcgatctcttccatcagcgcaatggcgttttgctgcgctttttcatgagagattttcttactgcgcgcttcgtcttctaccgcgcgggcgatcgctttcgaggccagcagtttgttaaacagatcctgacgggcgggcaggcgtgggccaaccgccgccaggcgctggcgagcaaagtgcatacgcgccacgcgagccagcttctgcgcgatgattttatcggtgccgtgttcatcagccatgcgacgcaatgagacggacggcgagaatcggacaaagctatcgcggcccagccaggagatggcaaagaatttctgtacgccgttcagcatacgtaaaggcgggttctcttctcctttttcacgacccggcgcgcggccaaacatcacggaaacgggcaccatctgcacgtccaaagctggattactccgatgcagatcgagataatcgtgaaaaagtttcaccgactcttcttttggcgtgtaataggtaaagacacgcggtccgccgtgaataaatacatagcgtggcaacagcgcgccgtcgatctccagcggctccagcggatccgggagatcgtgcgccagacattgcgcccgcagcgtcagtaagtccgcttttgagttgtatggcaagacatacataatggggcgagaagtatcgagccccaattcctgggcgggttccgccggaatagacttgctttttaccagtatgcttaatggtaaattcagtaatttgtagtaaattcgtggccagccggacataaacgatgtaaagcctctggttaataatgcaaatgcggtgcaaggatatcagaaagtttagcgaatttctgttgtatcccgtcatacttcgcgctgcgttacggcagtccgaatcgtgcagggcaaccgtataatgtcattgacgttaataatgtaaaaaggttcttttgatggccaataataccactggattcaccagaattatcaaagcggcaggatattcctggaaaggatttcgcgccgcatggactcacgaagcggcgtttcgccaggaaagcctcgcggtattgctgggcgtcatcatcgcctgctggctggatgtggatgcgattacccgtgtgttattgataggttccgttttacttatcatgattgttgaaatcctcaacagcgctattgaagcggtcgttgaccgcatcggttctgaataccatgagctttccggccgtgcgaaagatatgggatcggctgcggtgctactgtctattttcgttgccctgatgacctggggcatcctgttatggtcacattttcgataaaggttccaaattttataaatctcttgttttttgcgccgtttgtggttccaaaatcacctttaactgtatatactcacagcatgactgtatatacacccagggggcggaatgaaagcgttaacggccaggcaacaagaggtgtttgatctcatccgggatcacatcagccagacaggtatgccaccgacgcgtgcggaaatcgcgcagcgtttggggttccgttccccaaacgctgcggaagaacaccttaaggcgctggcgcgcaaaggggtgcttgaaatcgtttccggcgcatcgcgaggtatccgtctgttacaggaagaagaggacggattaccgcttgtcgggcgtgtcgcggcgggtgaaccgcttctggcgcagcagcatattgaaggccattaccaggtcgatccttcactgttcaaacccagcgccgatttcctgctgcgcgtgagcggtatgtcgatgaaagacatcggtattatggatggggatttgctggcggtacataaaacgcaggacgtccgtaatggccaggtggttgtcgctcgcattgatgatgaagtgacagtaaaacggctgaaaaagcagggcaataaagtggaactgctgccggaaaacagcgagtttacaccgatagtggtggatctgcgcgaacaaagctttacgattgaagggctggcggtaggcgtcattcgcaacggggaatggttgtaatctctttttaatctccttgtaagccgccatccggcaatcgtgtagcctgatggcgctgcgcttatcaggcctacgggaatgcagttcctgagatgattaatttgtaggccggataaggcgttacgtcgccatccggcaatgcgctcgtttcgtttaactccttgtcaggcttttctccatgccgctttttacctcctctgataaagctctctggcgtcttgcgttgccgatgattttttctaacatcaccgtccccttactggggctggtcgatacggcggtgattggtcatctggacagccctgttttcctgggcggcgtggcggtgggcgcgactgccaccagctttcttttcatgctgctgctatttctacgtatgagcaccaccggcctaacggcgcaggcatttggcgccaaaaatccgcaggcgttagcccgggcgctcattcaaccgttattgctggcgctgggcgcaggcgtgatgattgtgctatttcgcacgccgcttatcgagctggctttacatattgtcggcgggaacgacgctgtcctggtgcaggcgagacgcttccttgaaattcgttggctaagcgctcccgcgtcactggcgaatctggtgctgctcggttggctgttaggcgttcagtatgcgcgggcgccggttatcttgttggtcgtgggcaatatcctcaaaatcgcgctcgacctgtggctggtgatggggcttcatatgaacgtgcagggtgccgccctggcgacggtcatcgcagaatatgtcacgttactgatcggcctcatgatggtacgtaaagttctccatctccgcggtgtgtcgctggatatgctaaaacaggcctggcgcggcaacgtgcgccgccttttggcgctcaatcgcgatatcatgctgcgctcattgctccttcagctttgttttggcgcaatcacggtgtcaggcgcgcggctgggcagcgatattatcgcggtaaatgcagtcctgatgaccttactcacctttacggcctatgcgctggacggttttgcttatgcggtggaggcgcactccggtcaggcttacggcgcgcgtgacggtagcaagctactggacgtctggcgagcggcgtgtcgtcagtcaggaattgtggccttgttgttttccacggtctatgccctggcaggcgaacatattgtcgcgttactaacctcattgccgcaaatacagctactggcggatcggtatcttatctggcaggtggtattaccgctggtgggcgtatggtgctatctgctcgacggtatgtttattggcgcgacgcgcgctgccgaaatgcgcaatagcatggctgtcgccgcgggaggattcgcgctgacgctcttcgccctgccggtattaggaaatcatggtttatggctggcattaaccgtatttctggcgctacgcggtctgtcgttgagccttatctggcgtcgtcactggcgcgagggtacatggtttgccagatcgtgatggttaaaaattctgaatataaaaccgaaggccgaattcctgcctacaattattatcacgtccagcagaaattgcagtgcatttgggcgaataacacctgctattcctaaccgaatgatgaggacaagatgatgaataaagacgaagccggcggtaactggaaacagtttaaaggtaaaatgaaagaacaatggggcaaactgaccgatgacgatatgaccgttatcgaaggtaaacgcgaccaactggtaggtaaaatccaggagcgttacggttaccagaaagatcaggcggaaaaagaggttgttgactgggaaacccgtaacaactatcgctggtaatatgttttcccctatcaggagtacatggatgtgcttcccactgtttgcttatgaatgcgggcgtgcccctctctactgccgcccgtttttccgttcaggctaacgcggttttttcttcaccagcaccgagtgatcgtgaccacagtcgcccggatggcgacacgcttccacttctacgcacgcagggcacagaccgtgcgcctcaataacgttatgtcgtagcgcaaagcccattttagccgccagcgtatgcatgatgtcttccacgccctcggcacactcttccttcaccacgccgcaacgatcgcagataaacatggccgagctgtgcgtcggctggtcgaacaggtggcaaaccacataactattggtggattccactttatggacaaaaccctgttcgagcaaaaaatccagcgcgcggtagatggtgggcggtttggcctgtggttccgtttcgcgcagcaaatcgagcaaatcgtatgcgctgatggcaccctgttgcagactcatcaggcgcagcacttcgaggcgctgaggcgtcaggcgcacgttgcgctgcgcgcagagtttttcagcttgcgccagtaactcttgcgttgtggtcttttccatgtagcacctcgaatggcatgaaagtctaatccgttactttaccacgagctgcttaaaactctgaaattaccccgcgacaatatatcgcctgctaagcttttccgcgccagtattctcatctatacataatgagggtcgatattataacaacaggatttaacatcactatttcacagcaatagttcgcctctgtccggtaaagcgtggcggagggattacttcacctgataataagatgggctaactgtgaacaaaaacgtcaaactttcactgattgctatcgcggtctcgctttttatgacaaagcaggcgggcgccgccaatacctggacggaagcgcgtaatgacgcaatgggcgggacgggcgttgcgtccgcgaattatggcagcggagtactattaaatccggcgttactggcaaaagccaaaccggaagacaatatcactgttgtccttcctgcggtcggcgtccagattacggataaagacaatctccaggatgaaattgacgatatcagcgataaagtggattactacgatgaggtcgtcgataaccttacgctggggcaaattctgctcaatccgcgaggcgtgctgaatcaatttcagggcgccgcgcgcgacctggccgatgagctggaatatctcaacggaaaaaccgcccgcgccaatgccggcgccgggttggcggtaagtattccagggcaaacgctttccgtggcgtttatcgccaaaggttatgcgcatgggcgcgtgagttcgtccattgatcagaacgatattcagtatctgcgcgatatccagcatgatgaacgtgtcgcgcttcgtgaagcaggacgcgctgctttgctggggtctgacgaaattacaaagcatttaaactctaccgcgttggggcgggtagcgattgtatctgactacggtattgcgctggcgaagcagtttgtggtgggcgaggtgcctgtttccattggcgttacgccaaaactgcaaaaaacctggctctataactacaccacctcaatttataactacgacagtagcgactggaatagcagccgttatcgcaatgacgatacgggttttaacattgatgcggggcttgctgccgatatcggtgaaaattggacgttggggctgagcgggcaaaatctggtatctcgcgatatcgatacgaaagatatttacatcactaatggtatgacgggagaaaccaccaactacaaagagacataccaaatccgccccctggttaccgcgggcatcgcatggcataacgatttgctgaccgtaagcgccgatggcgatctgacggaaacgaaaggctttaagagcgaagacaattcacagtacgttggcgtcggcgctgaagttcgaccgttgtcatggctggcggtgcgcgcagggtatcgtgcggatgtgaaaaataacgatagcaatgtggttaccggcggtcttggctttgcgccctttaaccgtgcgcatctcgatttaatgggactgtacggcgaagatgaaacctggggggcaggcgcgcagcttacaatgacattctgaggtgctttcaccggaggcgctacgcttccggtttagcgttatgctatagtaacgccccttttttaaccggatgcttatttattcgccatgcagcctgaaacccagtcctccgctttacctgcttatcgcttctccatcgcgcctatgctcgactggacggacagacattgccgctatttcctgcgtttgctgtctcgccagacgctgctctacaccgaaatggtgaccacgggcgcgattattcacggtaagggtgactatctggcttatagcgaagaagagcatccggtcgctctacagcttggtggaagcgatccggctcagcttgcgcattgtgcaaagctggcggaagcgcgtggctacgatgaaattaacctcaacgtggggtgcccttccgatcgcgtgcaaaatggtatgtttggcgcctgtttgatgggcaatgcgcaactggtcgccgattgtgttaaagccatgcgtgatgtcgtctcgattccggtgacggtaaaaacccgcattggtattgacgatcaggacagttatgcgttcctgtgtgatttcattaatacggtttccggtcagggcgaatgcgagatgtttattatccatgcgcgcaaagcctggctttctggcttaagcccgaaagaaaatcgtgagatcccgccgctggattacccgcgcgtctatcagctaaagcgggattttccgcacctgaccatgtccattaacggcggcatcaaatcgttggaagaggcgaaggaacacttgcgccatatggatggcgtcatggttggccgcgaagcttatcagaattcgggtatactggccgcggtggatcgggagatctttggcgccgataccaccgataccgacccggttgcggtggttcgcgcgatgtatccctatattgagcgtgaattgagccagggagcgtatctggggcatatcactcgccatatgctggggttgttccagggtatccccggcgcgcgacagtggcgtcgctatctgagcgaaaacgtccataaagctggcgcggatgctgctgtactggagcaggcgctaaaactgatagcagacaagcgttaaaagttcgccaaaaattagtcaatctcaccacgctctgcgcagttttgcagggcgttttctttatatatcaaaaacataaatattggcatgatttttgtaatagcttacctgaccaaacccggtaagcgccgtgccgccgggcaatgccatctttatggggagcgactatgctggaactactttttgtgcttggcttttttctgatgttaatggtgacgggcgtctccttgctgggcattctggccgcgctggttgtagcgactgccgtcatgttcttgggcggaatgttcgccctgatgatcaagctgttaccgtggctactgctggcggtggctgtggtgtgggtgatcaaagcagtaaaaacgccaaaaatcccacagtatcagcgcaataaccgtcggttttactaaggtattgagcggttcgtcacaacctggaactttgccgtcacaagcaaataggaatcgattattaaatctgtcatgattgcgcaggtaacgaattcatcgcgctgtaccctatatacagccgaacaaaaaaagaaagggcttcccgggtggaagcccaatttctttgcagagctattacggaatcagcaggcttgagccctgtgtggcccggctttccagcacctcatgcgcgcgacgggcatcttttaacgcatagcgttgattttcagccacatcaactttaatcacgccgctggcgatcaatgagaacaattcattgctggcttcggtcagttcttcacgcgtcgtaatatacccctgtagtgaaggtcgcgtggcatacagggaacctttctgattcagaatacctaaattcacgccggtgacggggccggacgcattgccgaaactgaccatcagtccccgacgttgcaggcagtccagtgaggcttcccaggtatctttccccacggagtcatagaccacgcggacttttttgccgccggtgatctcttttacccgttcgacaatgctctcctcacggtaattaatcacctgccaggcgccggcgtccagcgcccgctgcgctttttgcgcgctaccgacggtaccgataagcttcgcgcccagcgctttcgcccattggcaggcgatcagaccgacgccgcccgcagcggcatgaaacaggaagggttcgtcgggtttcacttcataggttttgcgcaacaggtaaaaaacggtcaatcccttgagaaaagaggctgccgcctgttcgaaagaaatggcgtcaggcaaaatcgcggctttatctgcggggacgttatggacggaactgtaagcgccgagcgttgactgcgcgtagacgacgcgatcgcccacgcgaatgtgcttcacgccgctgccgactttactgaccacacccgcagcttcggttcccaggcccgcaggcaacgacgggggcggatagagtccgctacggatataggtgtcgatgaagttgataccaatggctttgttctcaacctggatttcgtgttccgccggttccgttggcgtaaactccacggtctgaagcacttccggaccaccatgcttgtgaaattcaatacgcgttgccatgcttcctccaaaagaaatgtggtaatctttcgacccaatcactatctcggtaactccattcactatggcaggaaataaacccttcaacaaaccacagactgatgcccgcgaccgcgatccgcaggttgccgggataaaagtgccgccgcactcgattgaagcggaacagtcggtgttgggcggtttaatgctggataacgagcgctgggacgatgtggccgagcgcgtggtggcggaagatttctatacccgcccgcatcgccatatctttacggagatggggcgcttgcaggaaagcggcagtcctatcgacctgattacgctcgcggaatcgctggagcggcagggccaactggacagcgtcggcggtttcgcctatctggcggagctgtctaaaaacacgccaagcgcggcgaatatcagtgcttatgcggacattgtgcgcgaacgcgccgtggtccgcgatatgatcgcggtggcgcatgaaattgcggacgccggttacgatccacaggggcgcaatagcgacgaactgctggatctggcggagtcgcgcgtcttccagatcgcggaaaaccgggccaacaaagacgaaggtccgaaaagcatcgaccagattctcgacgccaccgtggcgcgtattgagcagttgttccagcaaccgcacgatggcgttacaggcgtggataccggctatcaggatctcaataaaaagacggcaggattacagcgttcggatttgattatcgtcgcggcgcgtccctccatgggtaaaaccacttttgcgatgaacctctgcgaaaatgcggcgatgttgcaggataaaccagtactgatcttcagcctggagatgcccggcgaacagatcatgatgcgtatgctggcctcgctgtcccgcgtcgatcagacacgtattcgtaccggtcaactcgatgatgaagactgggcgcgaatctccggcacgatgggcattctgctggagaaacgcaatatgtatattgacgactcctcaggtcttacgccgacagaagtccgttcgcgcgcgcggcgtattttccgcgaacatggcgggttaagtctgattatgatcgactacctgcaattgatgcgtgtgccgtcgctttctgataaccgtactctggaaatcgccgaaatttctcgctcgttgaaagcgctggcgaaggaactccaggtgccggtcgtggcgctatcgcagcttaaccgctccctggaacaacgcgcggataaacgtccggtgaactccgacctgcgtgaatccggctctattgaacaggatgccgacttaattatgtttatctaccgtgatgaggtttatcacgagaacagcgacttaaaaggcattgctgaaattattattggtaagcagcgtaacggtcctatcggtacggttcgtctgacgttcaatggtcagtggtcgcgcttcgataactatgcgggaccgcaatacgatgatgagtaactctccgtcattcttttaacaaggaattcaaatgcaagcggcaacagtcgtcattaaccgccgcgctctgcgacacaacctgcaacgtctgcgtgaactggcgcctgccagtaagctggttgcggtggtgaaagcgaacgcttatggacacggtcttctggagaccgcgcgaacgctccctgatgctgatgcttttggcgtggcgcgtcttgaagaggctctacgtctgcgagcgggcgggattacgcagcctatcctgctgctggagggttttttcgacgccgccgatttgcctaccatttccgcgcaatgtctgcataccgccgtacataatcaggagcagcttgccgccctggaggcggtggagctggcggagccggtaacggtctggatgaagctggataccggtatgcatcgtctcggcgtgcgtcccgaagaggcggaggcgttctaccagcgtctgacgcactgtaaaaatgtacgccagccggtgaatatcgtcagccattttgcccgtgcggatgagccggaatgcggcgctaccgaacatcagctcgacatttttaatgtcttctgtcagggtaaacccggtcagcgctctattgccgcgtctggcggtatcctgctgtggccgcagtctcactttgactgggcgcgtccgggcatcattttgtatggcgtatcgccgctggagcacaaaccttgggggccggattttggttttcagccggtgatgtccttaacttccagtttgatcgcggtgcgtgaccacaaagcgggcgaaccggtgggctacggcgggacatgggtgagtgagcgcgacacgcgcctgggcgtggtggcgatgggttatggcgatggctacccacgagcggcgccttccggtacgccagtactggtcaatggtcgtgaagtcccgattgtcgggcgggtggcgatggatatgatttgcgtggatttggggccaaacgcgcaggataacgcgggcgatccggtggtcttatggggtgaaggtctgccggttgaacgtatcgctgaaatgacaaaagtaagtgcttacgaacttattacgcgcctgacctcaagggtggcaatgaagtatattgattaaatgcgcggcgggccgggtggcgcttgcgcttatccggcttgtatcgcgcatgggctgcaggccggataagacgttcacgccgtcatccggtaatatgcgcatccaccacaacatcctctcgatcttctcgtccttccggtttattgtgttatttcctgccctctgtaaacctggagaaccatcgcgtgtttcaaaaagttgacgcctatgccggcgatccgattctttcactgatggagcgttttaaagacgactcccgtcacgacaaagtaaatctgaacattggcctgtattacaacgaagacgggattatcccacagctcaaaacggtggccgaagccgaagcccggcttaacgcgcagccgcatggcgcctcgctgtacctgccgatggaaggactcaatacttatcgccatactatcgcgcctttgctctttggcgccgatcacccggttcttcagcaacagcgcgtggccactatccagacattaggtggttcaggcgcgctgaaagtgggcgcggattttctgaagcgttatttccccgacgcaggcgtatgggtgagcgaccctacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgctgctgcacccctgttgtcacaacccgaccggggcggatttaacgccttcgcaatgggatgcggtgattgagatagtgaaagcgcgcgatctgattccgttccttgatattgcctatcaggggtttggcgcaggcatggacgaggatgcttacgctattcgcgccattgccagcgccgggttacctgcgttagtcagtaattctttttcgaagattttctcgctgtatggcgagtgcgtcggcggcctgtcggtggtgtgtgaagatgccgaaatcgccgcgcgggttctgggacagctaaaagcgacggtgcgccgaatttactccagtccgccgtgtttcggcgctcaggtggtcgctacggtcctgggcgatgaggcgttaaaagcgagctggctggcggaagtcgacgcgatgcgtacccgcattatatcgatgcgccagacgctggtgaaagagctgaaggcggagatgcctgaccgcaacttcgattacttgttacagcagcgtggtatgttcagctataccgggttaagcgcggagcaggtcgatcggttgcgcgatgagtttggcgtttacctgattgccagtggccgcatgtgtgtcgctgggcttaatgcttcaaatgtacaccgcgtggcgaaggcatttgccgctgtcatgtaatattcaggccggacggcgataacagtgctctccggtctgacaatagctgttgtgatcatcctcttttttcgtaacaaaaccgcaaataatccttccttttgaccgttactggcgttatggtcagatagttttttgaccaaagactcatcttaataattataatattttgaattttaagggaaaagcatgaaaaaaataaccctggcgctgagcgccgtctgtttattgtttacgctaaaccattccgcgaatgcgttagtatcttccccttcgacgctcaatccgggcactaatgttgcaaaactcgcggaacaagcacctgtccattgggtctctgtcgcccagattgaaaacagcctgaccggacgcccgccgatggcggtcggctttgatattgacgacaccgtgttattttccagccccggattctggcgcggaaagaaaacctattccccggacagcgacgattatctgaaaaatccggccttttgggaaaaaatgaacaacggctgggatgagttcagtattccaaaagaagtggcccgacagctcattgatatgcatgttcgccgtggcgacagtatttactttgtcactggtcgtagtcagacgaaaacggaaactgtgtcgaaaacgctggcggataacttccatattccggcggcgaatatgaatccggtgattttcgccggcgataaaccgggacaaaatacgaaagtccagtggctgcaggagaagaacatgcgtatcttctacggcgattcggataacgatattaccgcagctcgtgattgtggtatccgcggtattcgtatcctgcgcgcggctaactccacctacaaaccgctgccgcaggcaggagcgtttggcgaggaagtcattgtcaactcggagtactaaaaatcaggagagcgacaggctctccttttttgcatgatttttgcacaaacttgccccgctggcttttaccttttccagacttgctgcacactattcaggagacgtttgtttttaggaaggagcagcctatgtggtatcagcgcaccattacactgagcgagaagccgcgcgggtttcatctaataacagatgaaattaccgataaattgtctggcttaccgcctgtcgaaacgggtttgctgcatctgttgttgctacatacctcggcctcgctgacgttaaacgaaaactgcgatcccaccgtgcgcgctgatatggagcgccatttcctgaaaaccgttcccgataatgcggcgtatgaatatgattacgaaggggcggatgacatgccttcgcatattaagtcgtcagtattgggcgtctcgttgctgctgcctgtacgccaggggcgtttacagttaggaacatggcaaggtatctggttgggagagcaccgtattcacggcggtccacgtaaaatcatcgcgacactacaaggggaatgataatgaccatttcggaattactgcaatactgcatggcaaaacctggcgcagagcagagcgttcacagcgactggaaagcgacgcaaattaaagtggaagatgtacttttcgcgatggtaaaagaagttgatgggcgcccggcagcctctctcaaaaccagcccggaactggcagagttgttacgccagcagcacagcgatgttcgatcgagtcggcaccttaataaagcgcactggagtacggtctatctggacggctcgctgccggattcacaactctattatctggtcgatgcctcttatcaacaggcggtaaatgcgctgtcggaagataaacgcaagcagttgccgcagtcctgattatagcgcgccgaccaacaacgccagggcgatatcaatgaggtggatgaccgtagaccggatacggctgccgagggcaatttgcgcattattggcgcgtagcctggcgaggtcccgctgtccttccagcagaataatcatatcgtcgtcgtccagccagccgcgagcatgttcctgaagcgcgcgggcgataaacgcggcggactcgcggataccgtcgtcgctgtcttctcttgcctgcttatacgtctggataaactcggcaattgccgaggaggctacaggatgttcggcccgggcggcagtaaacaggttacgtatttcgttaatagacgccattttcttctccctgagtgcagcgggcgccccaatgcagacactcaccctgtatggctaatttccagacctgattattttgctgttggtatctctcagcctggatgtaagtaagtggttgcttacatttcataacccgcgcataaagacgcaaatagtgatttttcagcagcgccagattatcgagtcggtgtttatccccaccttgacgggcgacccgctcagcctgaaaaaatgtctggcggatatcgcggtcatctttgagcagtgtctctttttgccacggtattcgcgccgcgtcctgcaggaagcgggttgagcgcgcttgtaatagcgtcagttgttgaaaagccacggcgctaaagcggtcaggcagcgtacaggcggctaaaaacaggcacagcagtagtgtgattgcgtagggcaacttcatggtgttttccataacagaccgtttgcgctatcacatgtcagagcgaggcggcacgcaaatcacaaatgctcaacacggatacaatgaggtgggatgaggaaaaatgatgccgcttcccggcgaatcggaaagcggtgtgaaggttatttgagcataggtttaaggaagcgggcggtatgcgacgcctcgcactccgccacggtttccggcgtaccggcgacgagaatttcgccgccgccgctgccgccttccgggccgaggtcgacaatccagtccgccgttttaatgacgtccaggttgtgttcgatcaccacgatggtgttgccctgatcgcgcaactgatgcagcacgtcaagcaactgctgaatatcggcaaagtgcaggccggtggtcggctcgtcgagaatatacagcgtctgcccggtgccacgtttcgacagttcgcgcgccagcttcacgcgctgggcctcgccgccggaaagcgtcgtcgccgactgaccaagacggatataggtcagccccacgtccatcagcgtctgcagcttacgcgccagcgccggaaccgcatcaaagaactcacgcgcttcttcaatggtcatatccagcacttcgtggatggtcttgcctttgtacttaatctccagcgtttcccggttatagcgcttgcctttgcactggtcgcacggcacgtaaatatccggcagaaagtgcatttcgactttaatgacgccatcgccctggcacgcttcgcagcgaccgccgcgcacgttgaagctgaatcgccctggcgtgtagccgcgcgagcgagactccggcacgccagcaaaaagctcacgaaccggggtaaagacgcccgtataggtcgccgggttggaacgcggggtgcgctcgatcgggctctggtcgatatcgatcactttatcgaaatgttccagcccctgaatatcccgatacggcgccggttcggcgatagtcgccccgtttaactgacgctgggcgatggggaacagcgtatcgttaatcagcgtcgatttaccggaacccgagacgccggtgatacaggtaaacagccctaccggtagcgtaagggtcacatctttcaggttgttgccgcgcgcgccggtgagtttgagcactttttctggatttgccggcacgcgttgtttcggcacttcaattttgcgtttaccgctcatgtactggccggtcagcgattccggtaccgccataatggcttccagcgggccttccgccaccacctcgccgccgtgaacgcccgcgccggggccaatatcaatcacatggtcggcggcgcggatggcgtcttcatcgtgttccaccacaatcacggtattgccaagattgcgcagatgaatcagcgtacccagcagccgttcgttatcgcgctggtgcagaccgatggacggttcatccagcacatacatcacgccgactaacccggcgcctatctggctcgccagacgaatacgctgggcttcgccgccggaaagcgcctctgccgagcgggagagcgtgagatagttcaggccgacgttcaccagaaacttgaggcgatcgccgatctcttttagcactttttcggcgattttcgcccgttgcccggaaagcttgagattagtgaaaaaatccatcgcatggccaatgctcatatcggaaatagcaggcagcggcgtattttccacaaatacatggcgcgcttcgcgattcagtcgcgttccttcacagctggcgcaggggcgattactgatgaatttcgccagctcttcgcgcaccgcgctggattccgtctctttataacggcgctccatattatgcagcacgccttcgaacggatggcggcgcacggaggtatcgccgcgatcgttcatatatttaaattcgatgttctctttgccggaaccgtacagcacgactttgtgtacgttggcgctgaggcttgcccacggcgcatccacgtcgaacttatagtgttccgccagcgacttgagcatttgaaagtagtaaaaattgcgacgatcccaaccacgaatcgcgccgcctgccagcgacaggtcgggattctggatcacgcggtccggatcgaaatattgctgaacgccgagcccgtcacaggtcggacaggcgcctgccgggttgttgaacgagaacagacgcggttccagctcgcgcatactgtagccgcaaatcgggcaggcaaaattggcggagaacagaagctcctccgctttctcatcgtccatatcggcaacaaccgccgtgccgccggataattccagcgccgtttcgaacgactccgccaggcgttgggaaagatcgttacgaactttgaagcgatcgatcaccacctcaatggtatgtttcttttgtagctccagcttcggcggatcggagagatcgcagacttcgccgtcaatacgggcgcgaatgtaaccctggcttgccagattttccagcgttttggtgtgttcgcctttacgctctttaataatcggcgccagcagcatcaggcgtttgccttccggctgcgacagcacgttatcgaccatctggctaacggtttgcgctgccagcggcacgtcatggtccggacaacgcggctcgcccacgcgggcaaacagcaggcgcaggtagtcgtggatctcggtaatagtacccaccgtagagcgcgggttgtgcgatgtcgatttctgttcaattgagatcgcgggcgatagcccctcaatatggtcgacatccggtttttccatgagcgacaaaaactgccgcgcgtaagcggagagcgattcaacgtaacgacgctgcccttcggcatacagagtgtcgaaagccagtgaggatttgcctgaacccgaaagcccggtcacgacaatcagtttgtcgcgggggatgacgaggttaatatttttgagattatgggtgcgggcgccccgaacttcgatcttatccattcacctttcccggtagagactcggatgcctggtttgtttgaaggacaaacggcagaaacggctaattatgacacaatttaacctgtttgaatatacagtattggaatgcatcttcagctaaagtatgcaacaatatgaggttcgcgcgagtgacctggaacctgcatcgcagctattaaaatgctacgtggaaatggtacactcacgcgtttacactatttatgaaacgtattcaggagactcaattatggccagcagaggcgtaaacaaggtgattctcgttggtaatctgggccaggacccggaagtacgctatatgccgagtggcggtgctgtcgccaacttaacgctggctacttctgaatcctggcgcgataagcagaccggcgaaatgaaagagcagactgaatggcaccgggtggtgatgttcggcaaactggcggaagtggccggcgaatatctgcgtaaaggttctcaggtgtatatcgaaggtcaattgcgtacccgcaagtggaccgatcagagtggccaggaacgctatacgactgaaattaacgttccgcagatcggcggcgtgatgcagatgctgggtggtcgccagggcggcggcgcaccggcaggcggtcagcagcaggggggttggggtcagccgcaacaacctcagcagccgcagggcggtaaccagttcagcggcggcgcgcagtcgcgtccacagcaatccgcgccagcgccgtctaacgaaccgccaatggattttgacgacgacattccgttctgatttttggtaaaaaactcaaagcgttatttgcattttcgctatagttctcgtctgctgaaatgcctggtgtaaaccaggcattttattacctggtattattgtcttagtatccctttcaaaaaagagaagcgcatatctcacggaatgacttacggaaaaatgtcgcttatcgcctctggccgactcgcctcggcacatcattatccagccgaagttcataaatgtactgcaataacccggattgtcttaaatatgaaagagaaatctcatctgcaaaatatataatttatagccattttttgacaacaaaaagatattataaaataacggtagagaatggtcggtattatcaatagttaattaaatgcttgctttagcttgtgatgagctcaaatatgatatgtgtatcttgctttatttttaattgctgaagataaaattgttacttatagctggctttatataaaaaatggttttatttgtgtatttttttacacaattctgattttttactccccacttattatattttcaatgatttaagttatattgaagtccctatgaccctatgttttaattgtgaaaattcattttatcctctggaggcaaatttattaaatacgtatggttataacgcgtattaaaaagaaatatgtccttaaaatgatttagagtttcaatgattagctaacaaatctatttatcggcgggtggttttaatttgctgatgactattttttatttatgagctgagagcttatgcgatacctattattggggaagatatagttagtgcaataattgatgtctacctaattaaaaaaatgaagagtgtttttaattaaagcactcatctttgttgtgggcgcataaaaatggcgtcgttgtttttatttttctgattacgagatgtaagaaaactgaaatctataaagcgtattggtagcaggaagccaagggtggtagcgttcactttctgaataagttgagcatcctttatcctttctaatccacaaaaacattttattcacaatgtaatatcaggagacaacatggaagacgaaagtaatccgtggcctagttttgttgatacattctctacggtattgtgcatttttatatttcttatgttggtgtttgcacttaataatatgattattatgtatgacaactcaattaaagtttataaagcaaatatagagaataagactaaatctactgctcaaaatagcggagccaatgacaattcaaatgctaatgaaatagttaataaagaagtgaatactcaagatgtgtcggacggaatgactacaatgtcaggtaaggaggttggagtatacgatatcgccgatggtcagaaaattgatataacatctacaaaaaatgagcttgttattacgtatcatggcaggctgagaagcttttctgaagaggatactcataaaatagaggcttggttagaagacaaaactaatagtaatttattgatagaaatggttattcctcaggcagacatctctttctctgactctttacgactgggatatgaacggggaattattttgatgaaagagattaagaagatatatcctgatgtagttattgacatgagtgttaactccgcagcatcaagtacaacgagtaaagctattatcacgactattaataaaaaggtgtcagagtgaaatatataaatcattatcgctatttgtttgtctgttttttccttgccatactcccttttttcgctttatcttttcccggtataagagagtatgtttttgataattttatggtttctgcaatttacaatggagtcattattgccatttatattacaggttctttgtgtgcattattcactattcttaaaaatatttcagcaaaagacatattaatagctcaggacgccagtagaaaaaatagcattctttctaacctcaatcaggttttgtttgccggggaacccaaacagtgtgatttcaatttactgatggaattagatgacaatgtgtctaccgcccgtaaccaacgattgtcatttattatgagctgtagcaatgtgtcgacgcttgttggcctgttggggacgtttgcgggtctgtctattacgattggttcaatcgggaacttattgagctcgccatcagatgttggcggtgataatgcaagtaatacactcaatatgattgtgacaatggtagcgtcgctttctgaaccattgaaagggatgaataccgcatttgtatcttctatctatggtgttgtttgcgccatactcctgacctcacaaagtgtttttgttcgcagctcctattcccttgtttctacagagatcaaaaaattaaaaatcataagtaacagatccaataataaacaacgaagcctgcgggttgaatcagagacgcttgtagaatttaaagagttgtttaaagcgttttttgataactacctgacagttgaaaacttacggacgcaggatgaagaaaagaaacgagtgatgctatcagatagctttgtcactttgcaaaaccgactattggataactcagcaaaactggaacaactttctacgctgattgatggttatctggtaagcaataacgaaaataccaaaaaattagttgacggtgtaataacaattacctctcgtttatctgaaggtaataccctgcttgctgataataatgcacgactggaggcaatgagtacaatacaaaatattatagacaaaaagaatgattcaataatggcatcagttgataaatgttatcaggaatctttttcacatggtaagaccataaacgatattgccgctggcagtgccgatatttctcatactctcgatgggctgagaaaagaaatggatgaggatatgaataatgttcatttagcgctatccgatctatcggctactgataaaaagattattgccaatactaaagagattagtgctgaaatggttagctatcgtgatacctatatgccattaatggaaaaaataacatctatgcatcaggaaatagtaaagcaacgtttgttaaacaaggaggaaaaaaatgaagattaagatgttttttctgacgactgcttttattacacaaagcacatacgccagcgagcttccggtcattcctctaagagatttagttaatgccgcattaacgcatcagccctctgttgctgtttcatattatgagactgaaaagaaaaacagtgacttagatctttcacgggcagcactttatcctaccctggatctaacctctggccttaataataacagaaaggagtcgtcaggtaccgagagaaacgttgaaaataaggtatctttatcataccgaataacggattttggagtgaggggggctaatatcaggaaatctgaatacgaaagagataatagtaaaactgactatgaaaaaacaaagaatatagtgtctcaggaggttgtgacaacctattacaacatcagtaaatatcgtgaaatgattgatggcgtaaatctggagaaagagttttataaaaagatgctggaaactttttcgctactggtatcttccggtgtagctatgcaatctgatatgcgtaaagtacaagtatctatcgatgcattaaataccagaagtattatgtatcagtcgatgctggatgatgaaatgtataaaatgcagaatatgactggtctgaatttatcaccagatcagattcaaagcgatgaaaaattcaacctcttcaaaaaatatatctttgtcgaaagccctgaaaaacttatggacatggtgatgaaatacaacgatgactataagatgcttgtcaatacccgaaaagctgcgaccgaagatattaatgccgcaaaatcatcctattttccgactgtagatctcgtttccagctatgtacagaataatccgagcggtagtgccaaaaaaagtgattatgaagatgaatttaaaacgggtatcaatgtcagtttcaacatttttaatgggtttagaaatgcagcccaggaaagaaaaatggtggcaagttactcgcaggctaagctgcaaattgacgatttcttgattaaaactcgttataacattgattcacaactttcaaaatacaccgctgcaaaagagacttactcagtggcggaacgttcacatacaaacgcgttacagcttactgaattatatgagcaggagtttcagttagggcaaaaaagtttgcttgatttaatttcaagccgtaatgaagcatttcaggcatatgtaagcatgatcgacagcaaatatagcctgtatattttaaagctacagcaactctcattgatttttcatttaatggattatttaaaaagtgagttaaatgtaatgaaatgaatagaagacaaagcgatcatctcatgatgataattatttctttgacgatcttaattattatccttacctactttatagaaattaattcagtggttcatggtcagggtgttatcactactaaagataatgctcagttaatatctctttctaaaggagggacgatacaagatatttatgtggccgagggggatactgtaaaaaaaggagaactccttgcaaaggtcgttaactttgatctgcaaaaagaatatcaaaggtatagaactcaaaaagggtatctggataaagatgttaacgaaatatctttcattcttgataaagaaaatgagagtggattgattaccctggatggcacccgttctttaagcaacaaagaggtaaaagcgaatattgaattagtgcatagtcagataagagctaaagagttaaaaaaaacctctcttgattctgagattagcggattacaagagaagctaagttcgaaagaaaaagaactagcattgcttgccgaagaaataaatattctttctccactggtaaaaaaaggaattagcccatataccaattttcttaacaagaaacaggcgtatataaaagttaagtctgaaattaatgatattgaaagtagcatcactttaaaaaaagatgatattgagctggttgttaatgatattgaggcgcttaataatgaattgcgattatctttatctaaaataatatctaaaaatcttcaggaacttgaggttgttaactctacattaaaagtaatagagaagcagataaatgaggaggatatctattcaccggttgacggtgtaatttataaaatcaataaaagtgccactactcatggtggtgtgattcaggcggcggacttactttttgaaataaaaccaaaagtaaggactatgctggccgatgtgaaaatactaccaaaataccgtgaccaaatatatgtagatgaagccgttaagctagatgtccagtcaattattcaaccaaagataaaatcgtataatgcgactatcgataatattagccctgactcttatgaggaaaataccggaggaacaattcagcgttattataaagtaattattgcattcgatgttaatgaagatgatttacggtggttaaaaccaggtatgactgttgacgccagtgtaattaccggaaaacacagcattatggaatacctgttatctcctttgatgaaaggcgtggacaaagccttttcagaaccagttaatactaaacgattagatacaccttgagagtgaatataatattatgggaaataaaagcatacaaaagttttttgccgatcaaaattctgtaattgatttatcttctttgggtaatgccaaaggcgcaaaagtttctctttccgggccagacatgaacattaccacgccgcatgggtcagtgatcattgtcaatggcgctctttattcaagtatcaaaggcaataacctcgctgttaaatttaaagataagactattaccggcgctaaaattctgggcagcgtagatttaaaagatattcaactggagagaattgacagctcattagttgattctgctcaggtagaaaagaaaggtaatggcaaacgacgaaataagaaggaagaagaggaattaaaaaagcagcttgacgaggctgaaaacgcaaagaaagaagctgataaggcgaaggaagaagcagagaaagctaaggaggcagcagaaaaaacgctcaatgaagcgtttgaagtacagaactcgtcaaagcaaattgaagaaatgctgcagaactttttggctgacaatgtagcaaaagacaatctggctcagcaaagcgatgcttcccagcaaaatacacaggctaaagcaacgcaggcttctaaacagaacgatgctgaaaaagttcttcctcaacctattaataaaaataccagtactggcaaaagtaatagcagtaaaaatgaggaaaataagctcgatgccgagtctgttaaagagccgcttaaagtcacattagcgcttgcggccgagagtaacagcggtagcaaagatgatagtataactaattttaccaaacctcagtttgtaggtagcactgctcccaatgccacggttattattaaaattaatggtattgctgtcggtcaggctgtagcggatagtttgggtaacttcaccttcacagcgcctgaaacattgactgatggaacatacaatctggaggcagaggccaagactgctgatggaagcggtagcgccaaacttgtcattactatcgattccgttaccgataagccaacatttgaactttcgcctgaaagtagtgtgtccggtcataagggcttaacgccgaccttgacgccttcaattgttggtacggcggaagagaatgctaaggttgacatttatgtagataataaactggttgccagcgttgatgtcgataaagatggaaactggagttatgaatttaaagataatgaattatctgagggcgaaaatagtataaaagtcgttgccgtggataaagcaggtaataaaaacgaaacgacggatagtatcataaccgacaccattcctccggaaaagccgacgattgagctggatgatagtagtgattccggcattaaaaatgacaacattacaaatagcactctgccaacatttattggtgtggcggaacctggttctacagtctctatttatcttgggcttaaacatcttggtgaggtcattgttgctaaagatgggacatggagctatacgcttactacgccgctcaaggatggcgaatacaatataacagcaaccgctactgatattgccgggcatacctctgcgacggcaaatctgccttttactattgatacccgtatcagctatttcagcgctgagattgaaacgactgatgatagcggtattgttggagataacgttactaacaatactcgcccaacctttacaggtaaaactgagccaaatgctattatcagtgtcataaatagtgagactggcgaagaggttatttttaaagcgaatgacaagggcgaatggacgttcaatttcacttcagactcagtggaaggggttaacaatcttacgttcactgttgaagatgtcgctggcaacaaaaaggatttttcctttagttacgttatcgatactgttgcccctgtacctccgacggtttctttggaggattttgttgttttaccgaatggtataattttatcagggaatgatttaccggctttagtcggtacggcagagccaaagtctaccatcttattgatgcgagatggtaaattatatgacagcattgaggttgactcaaacgggacctggaattatcagtttagtaataaatttcttcagggcgcctatgatattgaaatcatttctcaggatgccgccggtaataaatcctctactgttaaatattcttttactattcaaactgaagttgtacctccaaaagcggaactcgatgccagtgatgattccggtgcaaaaggcgactggattaccaataaacataatgctctgacattactgggaacagcggataggtttgctaccataaatatccttatcgatggtaaaacgataggcgtgacgactgcggatgcagacggtaactggaattttgatatttcccgaaatctgtctgacaatgtttataagattacggttgaatctatcgatcctttaggaagaacgtcatctgtagattatcagcttaccattgatagctttacgccgatccctactgttatgttgcatgatagcgctggctctggcgttaaaggcgatatgattactaaaattaatacgccgttgtttaccgggatggctgaagctaatgctaaggtttccatctatgttgacggtgtgttaagtggcgaggctattgctggcgatgatggtgtatggaattttcaatttaccacagcgttgtccgatggctcgcatgacgtaacggtaaaggtagaagatattgccggtaatactgcctcctcatcagcgtataatttccaaatcgtaacgcaaacgcaaaaaccaacaatagagttggtcaacgatacgggggttgataatacagaccatattattaatgaaaagaatcctgcactgacagggaccgctgcaccctattcaacggttaaactctatgttgatggcgcactaatcgctgaggtcagaacaaataaagatagcagatgggagtataccctgaaagccgatcaaggtttggttgatggcgatcatagaataaccgcttcagttgaagatatcgctggcaacattgcgcattcggatcctttcttaattagcgttgatactgctatttcaataccgatagtttcattgagcccggattcagattcgggaatcgcagatgataatttaacgaatatcgttaaccctaccttgcacctaaaagatattgatccggacattatcagcgttcaggtatgggatgccgcgtctgatacgcagatcggtgttgccacgcaacaacctgatggttcatggacctatacctttacttcagatttaacggaaggcttgcatcaggtttatgtcaaggttgaggacattgcgggtaataaagcgaacagcgcggtattcgattttactatcgataccacagtatcaacgccggtgatttccctgctttctaaggatgatacgggggtgacaggcgataacctgaccaatatcaataagccaggttttgctatttccggtgttgatgccgatgcgcatcgggtcgtcgtacaggtgatgcacaatggcgtgagcgaagagatcgaactttcccacctcaatggtagttggttatttacaccagggaatacgtgggcggatggcagctacacgttaacggtgaaagtagaagataaggcaggaaataccagctattcagcgccgctgacggtcgttatcgatacccaaatcgccattgatggggtggaactggtcaacgatagcggcgtgaaaggcgacaatatgaccaacgacgaccgtccccactttcgtgtgacggtacctacggatgtcaatgaagtccgtctgagcattgacggtggtaattcgtgggttcaggcaaccccgggcgtggcaggaagctgggagtatatctggccgacagacctggcagatggtcaatacacgctaacggtggaagcgactgataaagcaggcaatacagtgacgaagaccatcgatttcgcggtggataccacgctgtcagtgccggtcatcgtactgaatagcgcggacgataccggtgtccagggcgataacatgacgaatcgcacccagccgacatttgccctgcagcatattgatgatgatgccgttcgcgttacggtcagcgtggagcatggcggcgtcaccaccacatttgacgccacgaaaggcacaggcggatggacctttacgccgccgacatcatgggcggatggtgattataccctgagtgtgtcagtcgaagataaagcggggaacaccagccattctgcatcgctgacggtgacggtggacacgcaaatcgccattaataacattgaactggtcaatgacagcggtattcccaacgataatctgactaataatgtgcgtccacacttccaggtgacggtaccgacggatgtcaacgtggtgcgcctgagcattgacggcggcaagacgtggttcaacgcgacccagagcgcgacgccgggcgtctgggattatatctggccggatgatgtggccgacggaggctataccctgacggtagaagcgaccgatgaggcgggaaataaggcaacacagacgctcgatttcaccatcgataccactctgtctgtgccgaccctctcgctggacagcgcagatgacagcggcatcgcgggcgataatatcaccagtgttaaaacgccgggctttaccctcaacaatattgataccgatgtcagccgggtgatagtggaggtaatgcacaatggcattaaacaggaggtaccactggttcagaccggcggacagtggcgctttgcgccgaccagcgactgggcggacggcggctatatcctgacggtgaaggtagaagacagggccggaaatgtgaagcagtccgcgccgttgacggtgacagtggacacgcatatcgccattgaccgtattgaactggttaacgacagcagtatccccgacgataatctgaccaatgaagcgcgcccgcactttcaggtgacagtaccggcggatgttaacggtgtaagactgagcattgatggcggcaaaacgtggtttgacgccacgcagagcgcgacgtcgggcgtctgggattatacctggctgacgaatgtggctaacggccctcacaccctgatggtggaagcgaccgacaaggcgggaaacaaaacgacgcagaaactggacttcatcatcgataccctgctgtcagaaccgattattaccctggacagtgcggatgacagcgccgctggcgataacatcaccaacgttaagatgccaggctttaccctcggtaatatcgacgccgacgtgaccaaagtggtggtgacggtggcgcatgatggtaagaaccaacagatagagttgattaagaacggcggtgtgtggcgctttacgccgggcgcagcctggaccgatggcgactatacgctgacggtaaaggtagaagataaggcgggtaatacaaattattctgcgccgctgacggtgactatcgatacgcaaacgtctattgatcgcattgggcttcttaatgacacgggtattgtcggggataacctgaccaatgaagcacgtccacagtttcatattacggtaccgacggacgtgaactctgtgcaactgagtcttgatggcggcatcaactgggttaacgcaacgctgacgtctgacggcgtttgggagtatatatggccgacagatctggtcgaaaatacgtataccctgacagtgaaagcaaccgatgttgcaggcaacacggcgacggaaacgctcaattttatcattgataccacattgtcgacaccgaccatcacgctggatagcgcagatgatagcggcaccgccaacgataataagactaacgttaaaacgccgggttttattatcggcggtattgattctgacgtgactcaggtcgtcgtgcaggtgatgcgcgatggtcacagcgaggaggtggagctgacgcagactaacgggcagtggcgttttgtacccggcagcgcgtggactgatggcgactatacgctgacggtaacggtgaaagatgaggcgggtaatattcgccactcagcgccgttgacggtcaccatcgatacgcaaatcaccattgaccatattgaactggtcaatgacagcggtattcccgacgataatctgactaataatgtgcgtccgcacttccaggtgacggtaccgacggatgtcaacgtggtgcgcctgagcattgacggcggcaagacgtggttcaacgcgacccagagcgcgacgccgggcgtctgggattatacctggctggctgatgtgggagagggtaagcataccctgacagtggaggcgaccgacaaggcgggaaacaaaacgacgcagcaactggacttcatcatcgataccctactgtcagaaccgactatcgtgctggacagcacggacgacagcggaacaaaaggcgataacctgaccaacgtaaataagccgacgtttttactgggcaatattgacgcagacgcgcggtatgtcacagttgaggtacagcatggcggcacgaaagaggtgctgacggccaccaaagacgcgaccggcaactggagcgtgacaccgatcggcacatgggcagatggcgactatacgctgacagtgagggtggaagatgaggcggggaacgaaaaacactcagcgtcgctgacggtcactgttgatacccaaatcaccattgatgttattgaactggttaatgataacggtattcccggcgacaatatgactaacgacgcccatccgcagttccgcgtgacggtaccgggggatgttaacgaagtcagtctgagcattgacggcggtgtaacctgggttaaagcgatgcaaagcgcgacgccgggcgtctggaattatacctggccaaagacagtggcagatggtgactacacgttaacggtgaaagcgactgataacgcaggcaatacggtgaccaggacgctcgacttcactattgatactacgttgtcgacgccggttatcgtactggatagcgcggacgacagtggtgtccatggcgataacatgaccaatcgcacccagccgacatttgccctgcagcatattgatgatgatgccgttcgcgttacggtcagcgtagagcatggcggcgtcaccaccacatttgacgccacgaaagacgcaggcggatggacctttacgccgacaggggcgtgggcggatggtgattataccctgagtgtgtcagtcgaagataaagcggggaacaccagccattctgcatcgctgacggtgacggtggacacgcaaatcgccattaataacattgaactggtcaatgacagcggtattcccaacgataatctgactaataatgtgcgtccacacttccaggtgacggtaccgacggatgtcaacgtggtgcgcctgagcattgacggcggcaagacgtggttcaacgcgacccagagcgcgacgccgggtgtctgggattatacctggctggctgatgtgggagaggggaagcataccctgacagtggaggcgaccgacaaggcgggaaacaaaacgacgcagcaactggacttcatcatcgataccctactgtcagaaccgactatcgtgctggacaacacggacgacagcggaacaaaaggcgataacctgaccaacgtaaataagccgacgtttttactgggcaatattgacgcagacgcgcggtatgtcacggttgaggtgcagcatggcggcacgaaagaagtgctgacggccaccaaaggcgcgaccggcatctggagcgtgacaccgaccggcacatgggcagatggcgactatacgctgacggtgagggtggaggatgatgcggggaacgtaaaatactcagcgccgctgacggtcacggttgatacccaaatcaccatcgatgttattgaactggttaatgataacggtattcccggcgacaacctgaccaatgatgttcgtccacacttccgcgtcacggtgccaggggatgtcaacgaggtacgtctgagtatcgacggcggtaatacgtgggttcgtgcaacacagggcacggcagggatctgggattacacctggccgaaagatgtgaccgacgggctacataccctgacggtagaagcgaccgataaggcgggaaataagacgacgcagacgctcgattttaccattgatacccggctgtcaacgcctaccatcgctatggacagcagggacgatacaggtgccattggcgatcatattacgagcgtcaaaagaccgggctttaccattggcaatattgacgccgatgcgcactcggtcattttgcggatcacacagggcggcaatagccaggaagtgacactaacccaggttggaggacagtggcgctttacgccagatgctgactgggcggacggtagctatacgctgacggtagaggtaacggataacgcaggaaacgttcgtcagtccacgccgctggtggtgacggtggacacgcaaaccagcattactgatattacattggtcaatgatcatggcgtgcctgatgacaatctaactaatagcacccgtccgcagtttgagatcacggtgccggcggatgtgaattctgtgcaactgagcattgatgggggcgcaaactgggtgagcgcgacgcagggtatcgaaggcgtctggggctatacctggccaacggatatgggcgatggaaaacacaccctaaccgtcatggtcaccgacagagcgggcaatacggcgacgcaaacgcttgaatttttcatcgacacccggttgtcgacgccgaccattgcgctggatagcacggatgataccggtacgcctggcgatgatatgaccaatcgcacccggccgacttttattctgcagaatatcgattcggatgttatcaacgttacagtcagcgtcacgcataatggaacgacaacctcgtttaccgcgacacagggggctggaggatggagctttacaccgccagcgccgtggggcgacggtgattatacgctgacggtgacagtggaggatcgggcgggaaatacgcgtccgtctacgccgctgacggtgacagtggatacgcaaatagccattgatcatattgaattagtcaacgatagcggcgtccctggcgataatgtgacaaaacatgtgcgtccgcagttccagatctcggtaccggatgatgtggaaaaggttcttctgagtattgacggcggcacgacctgggttactgcaatcaagagttcgacggttggcatttgggattacacctggccgacggatatgccagagggacagcataccctgatcgtggaagtgactgacggtgcgggtaataagatgacggggacgctcgatttcactatcgacatcacgttgttgacgccaaccattgagctagcgcccgatcaggataccggacagaataagaacgataatctgaccagcgtcactcagccggtatttgtgttggggagtatcgataaagatgttcgacacgtggaattgagtattgagcataacggcacgtttaaaacggtggtactcaccgaatcagccgacggctggcgctatcgaccggattctgctttggcggacggtagctacacattcaccgtgacggtaacagatgtggccggtaatcagcaaacatccgcgcctttaaaggtgacgatagacggtacgttgactacgccggtgattgagctggcggccggcgaagatagcggtactgttggcgatcgcctcaccaatcacgatcggcctgtgttcgacatacgccagattgattctgacgttacgcgcgtgatggtcaaagtaacttacaacggtaaaacgcacgaggaagcggcggtattcaccaatggttaatggcgctttacgccttctgcgagctgggctgatggctcatatcagttagccgttgtggtggaagatctggcggggaatgtaaaagaatctgcgccgttagaggtacgtattgataccacgacaaccattaacaatatcgtattgcttaatgatactggcgtgcagaatgatcaattaacgaatgttgccaaaccgtcattcagaattgacgttcccggtgatgtcgtccaggtacgcgtaaccctggatggtggcgctaactggaatgtgatacgcaaaaatgccgacggacagtggatttttgacagcccgaatactctggttgacggcacatatacccttcgcgtagaggccacggatgaggcaggtaatattgcaaataaagatttagtatttaatatcgatactaatatacaggttccgactattgctttagacgcaggacaagataccggagcgaatacagccgataatattactaatatttcacgacccacctttacgattggtaatgttgaccccgatgttatcaaagtcgtggtgacgattgatggtcatgattataacgcgactaaggttggggctggttggcaatttacaccaggcaatgccattccggatggttcttataatattaccgttacggttgaagataaggccggaaataccgcgacatcgaaaccattacctgttgtgatagatacgacggctgaaattgaaagcgtcacgttggttacagatagcggtgatagcgatgtagataacattaccaaagtcgacaagccgcagtttagtattgttaccgctgatgatattacccatgtgcgcgttaaaatcgataacgccgctaattggattgaactcacaaaaggaggggatggtcgctggatatttaatgtcggttcggcattacctgatgggcaacacactctcttggttgatgtgactgatatcgccggcaacgttgcgcaagaaacgctgcagtttacgattgatacgactctgcgagagccgacaattgtactcgatcccacccatgatactggtgatgatactaatgataatcttaccaggattaacaaaccggtgtttattatcggtaatgtcgataatgatgtatcacacattgtggttcatcttgatggtcgggattacaccattgaaaacaaaggggggaatttaacctttacgccggatcaaccgctgtctgacggtcagcatacgatctctgttaccgtaacggatattgctggtaataccaaaacatcggccgaactgcagattgaaatcgacacgcaggttcagattgacagtgttacgttaacaacagatagcggcgtcaacgatcacgataatgtcaccaatgctacccgtccctcttttgaaattgcaacgcctgatgatgtgacatcggtgctggtttctttcgatggcgtaaactggacgcccatcagtaaaaatgcggccgggcagtggcaatttactgcaggtagcgcattgtctgatggtcattatactctccatgtccaggcgacggatcgggcagggaatacggcaaattccacgctgggctttaccgtggatacgcagattgacggcctgagcgtcgtgatgctggacgacgccggaaaggattctacggatggtattacgaatattacctctccacgttttgaaatttcagccagagaacagttgcagagcgtgacggtaattttaaacgggaaatccagcaccctgactcagggggcaggtaataaatggctgtttacccctgatacaccgttagtggatggaacttacaaaatagaaatagtggctgaagatatcgcaggtaataaaattagcaaagaggtatcattcacaatagacactattgtttctgatcccagtattgatttgctggatgcggatgatactggcgaaagcgctgttgataatattacgagtgtcactacaccacgtttcgttattggcaatgtacccgccgatattgatactgttgtaatcagaattaacggcgtttcttatccggttacggcaaatggcaataacctctgggaatttcaggttcccgttgcgttaaacgatggcgtatatgaagtcgttgttgtcttcagagatattgccggaaatacttctgaaactaagctgccctttaccattgataccacgacaagcgtcagtgtcagaatggagccagcgtctgataccggcagctccaatagcgataaccttacgaataagcaaaatcccaaattcgaaggtactgcagagcccaatgcgaaactggtgattaccattgttgacgataagtcaggtcgggaggttttaaaacacacgattacggttggcgccgatggcaactggagtgtgacgccgaatatactgccggatggcatgtataccatcaacgtcgtcgcaacagatgtcgcgggaaatactgcgcaaacgcaggaaagattcactatcgatacggttacgatcgatcccaccattcgcctttcggatccatctattgatgatcagtatgaggcaaccagcctgcgtcctgagttcaaagggctcgccgaagcgttctcgacgattatgattcagtgggatgggaaagtggtcggctcggcaaacgccaatgcgaatggtgaatggagttggacgccgccatcagtattagcgccaggctcctatgttgtgagcattgttgccaaagataaagcgggtaatgaatcgtcgcaggtcgactttcctgtagtaatacctgttattgatgtcacgcctccaaccataaagctcagcgaggagagcgatagtggtgccttaggagactttacgacgaataataaaacgccgaccctgattgggagcacgttacctaatacaattgtgagtatttatgtggatggcgtgaaggtcggcgaggcgacagcggatacagcgggccgatatactttccagttatcggaaatgaaagatggccattatgtcgtccaggtgggtatcgtcaaccctcgcgataatagcgaactgcgttccaccgccgttgatgtcactatcgataccgaggttgctgaactggtatggaatatatctggaatgcatgagggcggatatatcaacacggtgacgccggagattggcggcaccagtgagccaaacagcaaaatcactatctttgtgaatggcgttgaaaaagcgattgcttatacgacaggcgcaggacactggggcgtagtattacccgctttgggtaatgacggtaattatgaattaacgtttaaagttgaagacgttgccggcaatatcagagagtttggtccgcagaatgtgatactggatacggtaatttcgccgttaaccgtggtattacgcgaagctgatgacagtggcaaagttggcgactggatcaccaataaatctcatgtcaccatcgatggtactgccgaagccggaagtactttgaccatcaggaatccgcagggagtggttattgctaccctggtggtaggcaatgatggtcgatggagcgcagaattagatctgcgtgaaggtagtaatgcctttgtcgtggtatcggaagataaagcgggcaacggccaacaaaaagatattctgatagaacatgatacgcagattgaaatcagcgatatttcattaagtcgggatactaatagcggtgataaatatgatctgattaccaataataagtctccggtactggttgccatgaccgatcccggcgcgacggtacaggtttatattaatggtgtgttacaaggcacagtagaggcgagttcgtcaggtaatattagctataccatgccggcaaatagcgccgacggcgagtatcaggtgcaatttgttgctacggatactgctggtaaccgggttgaatctgcgattacgaccgtgacaatcgattctcaaattgctgtctttgatattgatgaagattcattaccggccctctctaataaccgggcgttgtcagtctcaggcgtcggggaggctggttctcaggtcagcatctttgtcgatggtaaattagtcaacgttgttatggttgaggctgatggctcatggcgcgcgccgatactgctgcaagatgatggtacgtttaatattcatttcagcattactgacgttgctggcaacactcaagtaagcaagaattacagtgtggatgtcgattcatcaaccgacttcccaacgctcaaccttgaagatgcgagcaactctggttcacttgacgatctgattactaatcacaacaagcctgtgttagttggcaccgcagaagcgggagccacaatccatatttatgtggatgaaaagatcgtggcaaatgtgcttgtgcttgaagatggaacctggtcctatcagtttgataatgcgttaaaagatggtgaatattctatccgtgtggttgccgaagacccggcaggtaatacggcagaatcgcctcgcttactcgtcacgatagataccagtacgtttatcgataatcctgctatggtggcaggttctgataacggtattttcagtaatgatagtataacgagtcagacccggcctacgtttagtatttttggagaaatgaaccagagtgttcagattttcattgatggggtgttagtcgatacgatcacggtgacggacagaaatcaagtttatcgacctgagtcaccgttgggcgatggttcccatagcatttattatgttatcaccgataaagcaggcaacacggctacctcgaaaacgctaaactttactatcgatacctttaatacgacgcctgtcgccattgattctatcggtggacaaacgttagcagagatgaccggtagtgatggcaaaatatatataacggacacgacgcgtaacttattgtttagtggcagtgccgagcccaatagcaaaatagaaatcattattaatggcttaaatgtgggggaagtttgggttaatgaaaaaggccactggcagatgccggtgaacccgctttatttcacagaaggccaactggatatcactgttaaatctacggaccgtgctggtaacgtaaatcaggaaaagtattccatttgggtcgatacgcatatccaggtatttaccagcgagcttgatgacaataaatcatcatcgaaaacggactggtggagtaatagctccactattaccatgagaggtatgggggaaattggcgctacggtatcattaatcgtggcaggggtcacgctggcaaccgctgtcgttgcggctaatgggcagtgggaattatcgaccgatcagcttccggaagggaaatacgatatcactttgagtattgaggataacgcaggcaaccgtaaggaagaggtacatgaaatatttattgatcgaacgccgccaaacgctccggtcgtaacttattcagacattgtcaacgatctaattattatgcagggaacggcggaagccaaatctcagctaataataaccgatagtaatgggaatacttatacgttaaccgttcctgataatggtaaatggagtatggcgatcccgtatccatcggaagggaagtttaccattacgagtgtggatgcgattggtaaccggagtgatgatgtccctctcgatatcatgaaagaggttcccgttatttcattatctccagactcagacagtggtacggtgggcgataatattacgcgcgataagcaacctacctttattatcgggaatctggaaagcgatgttgtggtcgttcaggtcgatatcaatgggacagtatataatgctgaaaaaaatgccgatggcgtttggttctttacgccaggtacaccgttagctgatggttcctatacgatatcggtaatcgcaagcgatgccgcgggtaatcagaaaaactcgttacccattaccgttacgatcgacagtacgctgacggtgccggagattgcgttggcagcaggtgaagacaatggcgtttcagacagcgataacgtgacgaatcacacccagcctaagttcacgctgcagcatattgatgctgatgtgaccggggtgaccgtaaacgtgacgcataacggcgtgacagacacctatcaggcgacgcaaggcgcggatggctggaccttcacgccgccagccgcctggaatgatggtacctacacgctgagcgtgacggtggtggatcgcgcggggaactcacagcaatctgcttcgctagcggtgacggttgactcaacggtgacggtaacagcggatagccagcatgacgatgcgagcgatgacgccacgccaacagcggttactccaccggagtctgaaacagtgaatgccgaaagcgatacgcatcttcgtacagtgccgtctgcggcggaagaaagcgtggtgaaggagacggcctatagtattacattgttaaacgctaactctggggatgaaatagatcgttcaattagtcagacaccttcttttgaaatatcagtacctgagaatattgttaatgtcagtgttatgtttgaaggagaagagtttactctgccgataactaaccagaaagcaatattcgaagttccgctatctttggaagatggtgaatatactatggacgtgaaattcattgataaggacgatgatttcctgattaaggaaaaaacattctcagtcgatcactcctcggcggatattgtgaacgcaatgaatgcaagaggaaagaccgaggatgatattaatgattccccttccacgagttctgtagggcacaacaataacggcgctattgatgttttcgccgttaatgaagttacgctacctgtagataatcaagaagaacacgcataataacggaggcccctcacctttgggtgagggggtttacttatggataaaaaactagaaccttattatttaagtgcggaaacggcattatctatagtgtctaaaaaattcaacataaaaattgacatcaaagaggatgatataaatttaagatttaaaaagtacgacagaaataacactgatgactctatacaaatgaagaatttctttttgtcgttagggctttctctacaggatatattatttaataatggtgaggatttactaaatgagcctatgccgattttactattaacaccagaaatgaagtggatggtgtgtgtgagcggcgggcaaaaaataaagttggtaaacgcgcgcggtgaactctgttatgttgaaattgaagatgaatatttaaaagagttatctgcatttagtatactacctttaaataaagttgttgatagtataagagtaaaaaatatcataaaaaactctttatcgatgaacaagattttttatactaaatacttcttttcatctctttttatggcaatttttgcgttaactatcccagtatttagtaatctgttctatgataagcttgttccaagcgcttcggtttcatcgttatttggcgtggctataattgttgctgtatttattgtttttgagtttatccttcgtacttcgaaagatatttatcagtctatcacagcaaggcaggatgacgtcgatattgatatcgcatttcttgaagcggtactttatagtaaaaagaaaaatggcagatccatgtcatcagcatttgtgctatggaatgagtttcagaaaattaaacccgttttattaaactcgatctttcaacgtatagccgatattccaatatttattatatttctcattgttatatatgtaaatttaggtctggtcgttattgtacctgttaccatgtttatcgtctctattattattttcctcgttaaccaccattatactaatgagttaatgaacaaacaaaaagaaggacagaagaacaggaatatttttatctcagaagttttcttatctattaaaatgatccataccttaaataatcaaggtttactttttgattgggtcaacacatcaaatgaacagtcgtatcttaacctgaagataaggaaattaaatcttatctatcaatctatattggggagtatgtcatctattacccaaataactattatggtaatagccttttttatggtaatcaagggtgatgttactactggcgcaattgtttcatctgtcattgtctctggtcgtatttccgggatcatttcgaatttttcttctacattaatctctattttatcagcagaaaaaaccggtaaggatctgctttctttttttgatgaagatcaggcagaaaaaacaccggcattacagtcaatatcaaagtgcaatggcgatatctctattcggggcgtgagttatcagtatgatgctcaatctccgatgattattaatcgactgtctatagacatacctgcggggcagcgtgtcgcagtgataggcgaatgcggtgcaggaaaaagctcattactgggaatgctatctggctacctttcgccaacagacggtgccattttatatgatggatataacttaggacatttatcgcagaactttttttctcagcatttaagtgtggtgacgacacatgatgttttattcaccggaaccattgaaagtaatttcgcgttaaaaccgcaaaacgacaggggacgagtactcaaggcgcttcatctggcgaactgtggttttatcttgcaacatcctatggggctgaagtttccggtgaattttatggctaaaaacctgtcatccggacagcagcagcagttattattagcacgtagtctgagcagtaacgccagcgtctttttatgggatgaaccaacatcaaatctggatgagaataccgagaagcaaatttttgataacttagatgagtttattcatgggaaaacgttgatcatggtgacgcatcgtcgatacctgataaagtattttgaccgggtcctggtaatgaaaggtggaaaaataatccgtgattgttctccggataaattattaatgtaaaataagccgcgcttgtcgctgttatcaggtggtactgcttaataaaaaagacccgttgcacaaacgggtctttttttgtcatttaacgagtcggcaacgtcttcaataagtttagctcgattctgttagggctattccacttgccatttttggataaccacacctggcggccctcatcaacggcaatgcgagggacgtgatggttcgcaaggctacccctggcgcgcgattccgccttgagataaccggtgggcgacttcagcggcagcgatagcgtatcaggtcagcaccatcggccattctggcggggtctggctcatcgtttcgaccatcacggcttcaatgttatgccagatcgcagcgagatccatcatggtaataccgagtaaaccggtggcaaaccagcaggcggataccacgcccagaccgctactgatcaccgccagaccaatataatctgatttacggaaacggatattgagcgtgctggctaaaaacatgagcacggcgctcaacagttgccagcggagaagaacgacaccagtggttatggcagccatgaaacatttcctctgaatagacctttgtccaggacagcacggcgttgttcccgggaaacgtgggacattctggctatcaacggacgtcacatcaacatcgaatgaaacattgtttctgtttcattgtttttgtgaactatatcacaaaaacaggcttattcgccagatcggcaatgtattttttgtgcgttttataaccttattttttgtgtgacttctgcgcgtccgtagagaaactgccggaaagcaaagatgtattattactactcttttattttttttcgtgaaattcagacctgataaaaatatcaagttatttatcaaaagaaaggagtaaagatgtataccccatcgtttacttgagtataaatctgatattatcaaaaatatttagtgtcctgcctggtatgcgaaagagattgcgcgtagttattaatggtaaatgttgatcggtaaaagtctgttgctaatattgataaattcatgcaccgtaaacctccgtttggttcacgtcttattttgccaataatagtcacaaataatgcagggaaataggctgaaaatgagtcaaagcacacgacgcaaggtgttgagatttctcggaacgatcattgtggtattacttcctgtattgctggcgatctggtttgctcatatccgggcagtctctgaaaccagaaatcagttacattcatttgcgcagttggtattagataaaacggagcgggttatcctgcaagcagatttagcccgcgatgccgctgaacaatatcaggggcaagcctgtacgccagcccatcaacagcgaatgctgaatattatccgcggtcgtttgtacattaatgagttgatttatgctaagggccagcgttttctatgctctacggttatgacgccaacaagtccttattttattccccgcgctgactataaacgaaagcctgacatcgctatttattactatcgtgatacgccttttttcaacggttataaaatgacatatatgcagcggggaaactatgtcgcggttatcaatcccttatcttatagcgaggtgatgtcagacgatccggcgttggcctggggaatgtatgatacggtgaccaacacctttttctccctgagtgaacaggcgcaggctgatcagctattacctttggtacaacggagtgaacctgtgttccaacagggtgagcgtttctatgctctggttaaatcagcaaaacgaccggttgccgcgattgtttcaacctcaaagcaacgcttttaccagaacctctttcatcagcttacgttaacgctaccgttagggatcatctgtagcattatcgtcttatttatgtggtcacgatcccggcaggcatattactcaccgcgtcgattgctgcaacgggccattaccaggcaccagctttgccttcattatcagccgatcattgatatccgaaacgggacatgtgtaggtgccgaagcgctattgcgttggccgggttatcacggtccggtgatgagcccgtgcgaatttattcctctggcggaaaaagaggggatgattgagcagatcaccgattatgtcgtcgaagaggtatttaatgatttaggtggttttctggccgcgcactcgcatctttatgtctctatcaatctctctgccgccgattttctctcttcccgactaattgtgatgattcatgaaaaaacgcgtcagcattcagtgcttgcgcaacagataaaggttgaagtgaccgagcgcggatttattgatgtgccgaaaatgacgccgattattcaggcgtttcgccaggcgggatacgaggtagcaattgatgactttggtaccggctattcgaacttgcataacctgtactcattaaatgtcgaccttttaaaaattgataaatcttttgtcgatacgctaaccactaatagcgccagccatttgattgtggaacatattattgaaatggcgcaaagtttgcggctaaaaatcattgctgagggggttgaaacggctgaacaggttagctggttgctaaaacgcggcgtgcagtattgtcagggatggcactttgcgaaggcgttaccgccgcaggaattcatcgtctggctacaacaaacgcccgcgcctctgacgatacgcgggcagacgccctacaggcggtgacggtaatcgctgggagtgcgatcgaactcgcggcggaatacacgcgagaaggtttgctgcgatacatagcccaggtccatcgcgatatcaaaaatcgggcgctcggtcgttcgtagctcaacggccgctaacaggagacggcgctggcgaatatactcgcctaatgtttgatgcgttaccgtacgaaacatccgctgcaaataccacttggagtaacccgatttttttgccaccacatcaatgtttagcggttggttgatatgttcatcaatccattcgataagggtctgaattatctgctgatgcgacatattgttgcctcttaaacagtattcgattcgtcgttttgtctgcgggcgagtataattcctcaagttaacttgaggtaaagcgatttatggaaaaaaaatctccccgtttaaaagccttactgacgccgggggaagttgcgaaacgtagcggtgttgctgtgtccgccctgcacttctatgaaagcaaagggctaattaccagtatccgtaatagcggtaaccaacggcgatacaagcgtgacgtgttgcgttatgtcgcgattatcaagattgcccagcgtatcggcatcccgctggcaactatcggcgacgcgtttggtatcttgccggaagggcatacgttaagcgcgaaagagtggaagcagctctcctcgcagtggcgcgaagagttagaccgacgtattcatacgctggtggcgttgcgcgatgagctggacggttgtatcggctgcggctgtttatcgcgtagcgactgtccgctgcggaatccaggcgacaggcttggcgaacacgggacgggcgcccggctgcttgaagatgattaacatgcactcggccatcgggctgagctcacctaaaactaaagcgccgctaagggcgctttagtttgtttccggtctttgtctttcgctctatcccgctgattacaggagggtttcccccgacgtcaacacctctcatattgagcacgtggtggaggttccggtttgtgttgatactgtaagtgtaagcgacgacgccctgttcgccagcgaaatgctgattttttagccgaaatttttacggcaactgccataattttctatagttagttggcataccttacaggagacagccatgctgacggtgcaccatttaaatcagtctcgttcgcagcgcatcctctgggcgctggaagagctggcgttgccttaccagattgtgcgttaccagcgtgaaaagaccatgctggcgccgccggcattgaaaaaagtgcatccgctgggcaagtctccggttatcgaagatcacggtatggttattgcggaattgggcgccatcctggaatatttgcaggacacttacgacaatatcggacgctttaagcctgcggatgcgcagagaaaacaacactatcgattctggctacattacgctgaaggttcgctcatgcccttgctattgatgagactgctctttacctctctgggtaaaccgccggtaccattgggcctgcgaacgttgggcggcgtgatcggtaagggcgcgcaaaaagcgtacctcaatccgcaactggaaacccatgcgcgctttattgacgggcatctggcaaatcacccctggtttgccggagagcagttaagtatggcggatatccagatgagcttcccgctatttgcgctgcttgcccgaggcggaatcgctcatctcgaccatatcaacgcatggaaagcgcgggtagaaatgcgtccagcctggcagcgagcgattcagcagggcggtccgtttaccattcccggcggataatggcgtttttgtgagcagattgcgcaacgtatttgctaacagcgatgcgaaaaattgttgctggattgcgcagggacgataacgtttgcgcatcgtctggctatttattgagcatactaagcagaaaagcataaaaagcggcaaagttcagttgaaaaagcgttgatgatcgctggataatcgtttgcttttttttgccacccgttttgtatacgtggagctaaacgtttgcttttttgcggcgccccggctgtcgtaaatgtagcacaaggagataacgttgcgctgttagtggattacctcccacgtataccgacgaataataaattctcaggggatgttttctatgtctacgccttcagcgcgtaccggcggttcactcgacgcctggtttaaaatttcacaacgcgggagcaccgttcgccaggaagtcgttgctggcttaaccacgtttctcgcgatggtttactccgtcatcgtggtgccagggatgctgggtaaagccgggttcccgcctgccgccgtctttgtagcgacctgcctggtcgcaggcgtcggctctattgttatggggctatgggcgaatctgccgctggctatcggttgcgctatctcgttgacggcgtttaccgcgtttagcctggtcctggggcagcatattagcgtcccggtcgcgcttggcgccgtattcctgatgggcgtactgtttaccattatctccgctaccggcattcgtagctggattttgcgtaacttgccgcagggcgtggcccacggaaccggtatcggtattggcctgtttttgttgctgattgccgccaacggcgtcggcctggtcattaaaaacccgctggatggcctgccggtcgcgctgggcgatttcgataccttcccggtgattatgtcgcttgtgggtctggctgttattctcggtctggaaaagctgaaagtccccggcggcattctgttgaccattattggcatttctattgtgggtttgctcttcgatcctaacgtccatttttccggcattttcgccatgccttcgttgagcgatgaaaacggcaactcgctgatcggcagcctggatattatgggcgcgttaaaccctgtcgttctgccaagcgtgctggcgctggtgatgacggcggtgtttgatgcgaccggcacgattcgtgcggtcgcagggcaggctaatctgctggacagagacggacaaattatcgatggcggcaaagcgctaaccaccgactcactgagtagcgttttctccggcctggtcggggcggcgccagccgcggtgtatatcgagtctgcggccggtacggcggcgggtggtaaaacgggcctgacggcgattaccgtgggcgtgctgtttttgctgatcttgtttctttcgccgctctcttatctcgttcccgtctacgcaaccgccccggcgctcatgtatgtcggtctgctgatgctgagtaacgtggcgaaaatcgattttgctgatttcgtcgatgcgatggcggggctggtaacggctgtatttattgtactgacctgtaacatcgtcaccgggattatgatcggctttgccacgctggtcgtcgggcgtctggtttctggtgaatggcgtaagctgaatatcggaactgtcgtcattgcggtcgcgctggtcgctttttatgccggcggctgggctatctagttctgccttcattctgaaaaatgggcggcgttggtcgcccgttttcattttcaggacacatcacgttaccttttgcgttaatctgaagaaggtgaaaccgaggcatgatgcctttctccatcataaaaaacatcgcaaacagggaacgcatggaaattttcttcacaatactcatcatgacccttgtggtctcgctgtcgggggtatttacgcgtgtattacccttccagcttcctttaccccttatgcagatcgccattggcgcgctgttggcgtggccgacgtttggtttgcatgtggaattcgacccggaactcttcctggtgctgtttattccgccgctgctgtttgcggatggctggaaaacgccgacccgtgaatttcttgagcatggacgagagattttcgggctggcgctggcgctggtcctggtaacggttgtgggaatcggcttcctgatttattggctggtgtccggcattccgctgatccccgcatttgcgctggccgccgtgctgtcgccgaccgatgcggtagcgctctccggaattgtgggcgaggggcgtatcccgaaaaaaatcatgggcattctgcagggagaggcgttaatgaacgacgcctccggtctggtatcgctgaaattcgccgtcgcggtggcgatggggacgatggtctttaccgtcggcggcgcgacgctggaattttttaaggtcgctatcggcggtattctggcgggttttgtagtcagttggctgtatggccgctcgctgcgttttttgagccgctggggcggcgatgagcccgcgacgcaaatcgtcctgctgtttctgctgcccttcgcgtcttacctgattgccgaacatattggcgtctcaggcatcctggccgcggttgccgccgggatgaccatcacccgttctggcgtaatgcgccgcgcgccgctggcaatgcgtttgcgcgcgaacagtacctgggcgatgctggaatttgtctttaacggtatggtctttctgctgttgggactgcaattgccagggattctggaatcttcgctggcggcggcggaagctgacccgaatgtcgaaacctggatgctctttaccgatatcgtgctgatttatgcggcattgatgctggttcgcttcggctggctgtggaccatgaaaaagttcagcctgcgctttttgaagaagaaaccgatggagttcgccagctggacgtcgcgtgaaattctgattgcttccttcgctggcgttcgtggggcgatcaccctggctggtgtgctctctataccgttacttttgccggatggcagcggatttccggcgcgttatgaactggtattcctggcggctggcgtcattctgttctcgttgtttgtcggcgtgatcatgctgccgctgctgttgcaacatctggaagtcgtcgatcatgcgcaacagttgaaagaggagcgtatcgcccgcgcggcgacggcggaagtggcgattgttgccattcagaaaatggaagagcgtctggcggcggataccgaagaaaacatcgataatcagttgcttactgaagtaagctcgcgtgtcattggtaacttgcgtcgccgtgccgatgggcgaaacgatgtcgaaagctccatacaggaagaaaacctggagcgacgtttccgtctggcggcgctgcgttccgaacgcgccgagttgtatcatctgcgcgccacgcgagaaatcagcaatgaaacattgcaaaagctgctgcacgacctggatttgatggaagctctactgatagaaaatcagtagtccttgtggcccggtggcgccatgcttatcgggcctacaagtaggcccggtaaggtgcttgcgccgccatccggcaagggttttaacccatggcttacggttgtttcagccaaaacccttcgcaacaggttaaccatgcccgggcgctgtgcgacagatacacgccctcgcgccaaatcatgcccaactgccagcggagatcactttccagcggtagccagcgcagcgtggccttatccagacgctgacaaatcggctccggcaaaatggcgatgccgacgcccgcttgcaccatggcggcgagaaaatcccattgcccgctgcgcacggcaatccgtggttttacgtcatgctggctaaataagatcatcaactggcggctcagggcaaagtcttcgttatagataagaagaggatgctccgccagagcttcaggcgcgatggagtcgcaggttgtccactgaccggaacggggaaccagcacgcacagcggatggctgaacagcgataatgtcgtcagcccgctcgcttcttccaccgggagcgcggtcatcgcaacatccagctcgccattcattaccgcctgctgtaccgtcaggccgccaaactccgaaattttgagttcaacgccagggtagcgttgtcgaaacaaactgattggcccagccatcaacatgccgaccatcgggggaatacccagccgcagcacgcccttattgagatggttaatatcgctcaactcggcctctaactggcgaaactcagcgaggatcgccagaccgcgttcaaacaccacgcgtccggtatcggtcagcaataacttacgtccgtcgcggatcagtagcgtacagttaagctcatcttcaagatttttcagcatcttgctaatggtgggctgggtgacaaataacttctccgctgcgcgggtgaaactttgctggcgcaccacctcgacaaaataacgcagcgttctgatatccatgattattccttccgactatgcctgcaatgattttaattcatttctgcccgtgacggaggttctctatactggcgctccgtattatttttcaggacattccctcatggctgtggcgataagccgcgttacgcctgccgttgtgcaacgactccaggtaccggttcaggtactgctctatgcaggtttattcattttttcccaatattttgtctcctggctgcacctgccgttgcccgcgaatctggtcggcatggtacttatgttggcgctgatcgtttgccggattattccgcttagctgggtacgcgcaggcgcacgctggctgctggcggagatgctgttattctttgttcccgccgtcgtggcggtagtgaactatgcccatctgttactggtggacggctggcgcattttctcggtgatagcgatcagtaccttaatggtactcggcgcgacggcgtgggtggtggataaagtgtatcgctatgagatgagcaggctaaaccgtgaataacgttcagttaagcgtactgtgcctggtgattacgctgggaatttacttcgccaataagcgtctgtatcgccgttttcgcaaattgccgttgatgccattagtgttgacgccggcactgctggtgttaatgctggtgttcggtcatatctcctggcaaaactatattagcgaatcgcactggctattgtggctgctcggcccggcgaccattgcctttgcggtgccggtgtacgataacctcgcgattatcaaacgtcactggatgtcgctcaccgcgggtgtagtgacggcgacggtggtggcggtcaccagttccgtttggctggcgcgtctgttcacgttatcggatgagattcagcgtagtctggcggtacgttccgttactacgccgtttgcgctggcggcggcagaacccctgggcgggcagccggatctggtggcgctgttcgtggtcgtcactggcgtgtttggcatggcggtcggcgacgcgctatttttgcgtctctctatccgggaaggcatggcaaaaggggcaggattcggcgcggcgtcacatggggcaggcacggcgcgttcctatgaacttggtcagcaggagggcgtcgtcgccagtctggtaatgatgctgtccggcgtggtgatggtgctggcagccccgctggtggcgagggtgatgttctgattttcctccgacccacagggccggaggaaacggtaagattaatgcgcacgcccttgttgtacgccgaatcccgtttgggagcggataaactgagcgcggaactgctcacgttcacggttgccttctgccgagttatcggtggccgagaagaaccagatccccaggaacgccacgctgatagagaacagcgccggatactcatacgggaagatcgctttttcgtggccgaggatctgcacccaaatggtagggccaagaatcatcagcaccaccgctgtcagtaaacctaaccagccgcccagcatagcgccgcgcgtggtcagttttgaccagtacatggaaagcagaatgatggggaagttgcagctcgcggcgatagcaaatgccaggcccaccataaaggcgatgttctgattttcaaacaggacgccgaggataatggcgatcacgtccagcaccaggacggtgattttcgacaccttcagctcttcacgttcggttgcgcctttgcggaacacgttggcgtacaagtcatgcgacaccgccgatgcgcccgccagcgtcagacctgcgaccaccgccagaatggtggcaaacgccactgccgaaataaagccgaggaacaggttgccgcctaccgcgttggccagatgcaccgccgccatgttattgccgccaatcagcgcgcctgcggcatctttataggcgggattcgcccccaccagcatgatagcgccgaagccgataataaaggtcagaatgtagaaatagcccataaaaccggtggcgtagaacacgctcttgcgcgcttcgcgggcatcgctgaccgtaaagaaacgcatcagaatatgcggcaaaccggcggtgccgaatatcagtcccagacccaacgacaatgccgaaatcggatcttgcaccaatccttctgggctcataatcgccgtgcctttcgggtgtaccgccatggcttcggtaaacagattattgaagctaaagccgacgtgtttcatcaccataaaggccataaaactggcgccaaacagcaacaggacggctttgataatttgcacccacgttgtcgccagcatcccgccgaacagcacgtacatcatcatcagcacgccgaccagcactacggcgatgtgatagttgaggccgaacagcagttcaatcagtttaccggcgccgaccatttgggcgatgagataaagcgccaccactaccagggagccacaggccgaaagaatacggattggcccctgtttcaggcgataagaggcaacgtcagcaaaagtataacgtcccagattacgcaggcgctcggcaatcaaaaacaggataattggccagccgacaaggaagcccagcgaatagatcagcccgtcataaccggaggtaaacaccagcgcggaaatgccgagaaatgacgcggcggacatatagtcgccggcaatcgccagcccgttctggaacccggtgatattgccgccagccgtgtagtagtcgctacgggaacgtacgcgtttagaggcccagtaggtaataccgagcgtaaacacgacgaaaatcaaaaacatgataatcgcctgccagttggtgggctggcgttcaaccgcgccgctaatggcatccgccgcatgagcggcgaaggggagtgcggcggcgagcgccgtcagaactctcttcataatgctttcacctcatgcagtacggcgttattaagacgatcgaattcgccattcgcccgccagatataaattccggtcaacacaaaagaaatcacaatcaccccgacgccaatgggaattcctcgggtgacgctggttcccgcatgtagaggcgtgcccagccagccaggcgcgaaggcgatcagtaaaataaagctgatataaaccgccagcatgataaccgacagaatcgtggcaaaccgttgccgtttttcaactaattccctgaaacgcgcactgtcttctatccgctgataaatttggtcattcatcacagagctctccagaggtccccctgcgtctttcgcgctacaggcgcgctggccgcactcgcgcgccccagccacatagtgaactatgctgctgagggtgtgctcgcttgccgccttcctgtaacacgaaatcctttgggggagggtttttatatttccctctcccggtttgagagagggcaggggtagggtcgtaggccggataaaacgcgttcgcgttgccatccggcatttatggttatgacggcatcgcgatggcctgcttctcttcgagcagtttctccaccacgccaggatcggcgagagtcgaggtatcgcccagattgctggtatcgcccgccgcgattttgcgcaaaatgcggcgcataattttgccggaacgggtttttggcagtgagtcggtccagtgcagcacgtccggcgtcgccagtgggccaatctctttacgtacccagttgcgcacctccgcgtacagttctggcgacggctcctcgccgtggttgagcgtcacataagcgtaaatcgcctggcctttgatagcgtgtggaatacccaccaccgccgcttcggcgatcttcggatgcgccaccagcgctgactcgatttccgccgtacccagacggtggccggagacgtttaacacgtcatccacgcgaccggtgatccagtaatagccgtcctcatcgcgacgcgcgccgtcgccgctgaaatacatattcttaaaggtagagaaataggtctgctcaaaacgttcatgatcgccgaacagagtgcgcgcctggcccggccaggaatcggtgatgaccagattgccttccgtcgcgccttcttgcggatggccttcgttatccaccagcgcaggctgtacgccaaagaaaggacgggtggcggaaccggctttcagttcgatagcgcctggtagcggcgtgatcataaaaccgtctgtttcagtctgccaccaggtgtcgacgaccggacatttttccttgccgatcttcttccagtaccattcccacgcttcgggattgatcggctcgccgacggaacccagaatgcgtagtgaagaacggtcggtgccttcaatggctttatcgccttccgccatcagcgcgcggatggccgtcggggcggtatagagaatgttgacctggtgtttgtcgaccacctggcacatgcgagcgggcgttggccaattcggcacgccttcaaacattaaggtggtcgcgccgcaggccagcgggccatacaacagatagctgtgccccgtcacccaacccacatcggcggtacaccagtaaatatcgccagggtgataatcaaagacatacttaaaggtggtcgcggcgtagaccagatagccgccggtggtgtgcagcacgcctttcggcttgccggtggagccggaggtataaaggataaacagcggatcttcggcattcatcgcttcaggctggtgctcagggctggctttttcaatcaaatcgcgccaccacaggtcgcggccttcttgccagtcaatgtcgttgccggtgcgcttcaggacgatcacatgctcaacgctagtgacattcgggtttttcagcgcgtcatcgacattctttttcagcgggatactgcgtccggcacgtacaccttcgtcagcggtgatcaccagccgcgagctggagtcgataatgcgtccggcgatggcttccggcgagaagcccccgaagatcaccgaatgcaccgcaccgatgcgggcgcaggccaacattgccaccgccgcttccggcaccatcggcatataaatcgctaccacatcgccttttttaatgcccagatccagcagtgtattcgcgaaacggcagacatcgcgatgcagttcgcgataagagatatgtttactctgcgacgcgtcatcgccttcccagataatggcggtgcgatcgccattttcctgcaaatggcggtcaagacagttcgccgccagattcagcgtgccgtcctcgtaccatttaatcgacacattgcctggcgcaaaggaggtgtttttcactttttggtacggcgtgatccaatcgagaatttttccctgttcgccccaaaacgtatcggggtcgttaatagactgtttatatttagtctcatactgctctggatttatcaggcaacgatccgcaatgttggcgggaatggcgtgtttatgtgtttggctcatgctgttgttctccttgtaggatgttaataatatgtcgcataaacgttaaatgtagggtcttaataagttttgtttagtatttgggcgacagatcacgcaaaaagggagctgtgcaaataagcagcaatctattttttgattgtgtcccgtaaaattagataaattttcgggataacatgacgttatatgaaattttttaaaaaagtgatccgtgtccggaaatcagaaaagagagggagttttgtccaggttactaactctaaagtggtattttacatacacttacaattgattaaagacaacattttgagtgtggttatttgttacacatagaggagatcaatgtaataacagtatttgtgcggttgctgttatggaaaacgataaaaaatcgccattaaagataatggcgcaatctggatgagacctctatggcaaggaaaacactacgcgcacgccgtttcttcagccttatatttccttttttcttcattacctctgtttacgctgagcaaacgcctgtatccgcaaaaaccgttactgttgaagcgaaaaatgaaacgttcgcgcctcaacaccccgaccaatatcagtcatggaaagcgacgtcagaacagtctgcccgtgaagatgcgctggcggaagaccctcgtctggtgatcctgtgggcgggctatcccttctcccgtgattacaacaaaccacgcggccacgcgtatgcggtaaccgacgtgcgcgaaacgctgcgtaccggcgcgccaaaaacggcggaagacggcccgctgccgatggcctgctggagctgtaaaagccccgatgtcgcgcgccttatccaacaagaaggcgaagacggctacttccatggcaaatgggcgcgcggcggcccggaaattgtcaacgatttgggctgtgccgactgtcataacaccgcgtcggacgatttcgcccaggggaagccagcgataacgttgtcgcgcccctatgccgaacgggcgatggaggctatcggcaaaccgtttgataaagcgggacgatttgatcagcaatcgatggtctgcggccagtgccacgtggagtactacttcgacggtaagaacaaagccgttaagttcccgtgggatgagggcatgaaggtcgaaaatatggagcaatactacgacgccatcgccttctctgactggactaactcgctgtcgaaaaccccaatgctcaaagcgcagcacccggaatatgaaacctggagcgcgggcattcacggtaagaacaacgtgacctgtatcgactgccacatgccgaaagtacagaacgccgaaggcaagctctacaccgaccataaaatcggcaacccgttcgacaatttcgcgcaaacctgcgccaactgccacacccaggacaaagcgtccctgcaaaaagtggtcgccgagcgtaaacaggcgattcatgacctgaaaatcaaggttgaagatcagctggtacatgcgcacttcgaagcgaaagccgcatgggatgcgggggcgacagacgcggaaatgaaaccgattctgaacgatattcgccacgcgcagtggcgttgggatctggcgattgcgtcacacggtattcatatgcatgccccggaagaaggtctacggatgttaggcagtgcgatggataaagccgcggatgcccgaactaaactggcgcgactgctggcgaccaaaggcattacccatgaaattccgctgccggatatttcgacgaaagagaaggcgcagaaagcgattggtttgaatatgcaacaaatcaacgcggagaagcaggacttcctgaaaacggtcgtaccgcagtgggaagatcaggcgcgtaaaaacggtctgttaagccaataacctcacatgtgacaaatttgccggatgacagcgcaagcgctttatccggcctacagaagtcttgtaggccttaaagctgcgcgccatcaggcattatgtaatggagtgaatatgagcgtattacgttcgttattaactgctggggtgctggcatcaggcctgttctggagcctgagtggaattactgccacgccaacgccgcaggagtcggatcaacgctggacggtcacccagcagcgtaatccggatgctgcctgtctggactgtcacaagccggacaccgaaggtatgcacggtaaacatacgggcgctatcaacccgaacaataaattgccgataacctgtaccaactgccacggtcaaccgtcgcttcaccaccgtgaaggggtgaaagatgtgatgcgttttaacgacccgatgtatacggtagagcagcagaacagcgtctgtatgtcctgccacttgcctgaacaactgcaaaaagcgttctggccgcacgatgttcatgttactaaagtgacctgcgccagttgccattccctgcatccgcagcaagacacgatgcagacgctaaacgagaaagggcggatcaaaatatgcgtggattgccacagcgatcagcgtactaacccgcactttaacccggcgtccgttccgttgcttaaggagcagccatgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgaccggcgcatcatttcgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaactaacctgaaagcgggcaaacagcccgcctgcgttgagtcatgtctaacgaaggcgctgacgtttggtaatctggacgatcccaacagcgatatctcccgtttgttgcggcagaaaaccacctatcgttacaagctggcgctgggcacaaaaccgaaggtctaccgcgttccctttaactatggggaggtgagccaatgacatccgcttctgcatttcattttgcatcactggtgtgggactggcccatcgccatctatctgttcctgattggcatctccgccggactggttacgttggcgattctgctacgccgcttccatccggaggcgggcggttcggacagcacgctgctgcgcactacgctggtgttagggccgggggcgattattcttggtctgctgattctggtcttccacctgacgcgcccgtggaccttctggaagctgatgtttcactacagctttacctcggtgatgtcgatgggggtgatgctgttccagctttacatggtggtcctgatactgtggctggcgaaaatctttgaaaaagaggtgattgccctgcagcaacgttggctgccgcggttagagatcgtgcagaaagtgttgacgctgatcgcgccgttccaccgtgcgctggagacgttaatgctggtgctggcggttctgctcggcgcgtacaccggctttctgctgtcggcgctgaaatcctatccgttcctgaataacccgatcctgccggtactattcctgttctccgggatttcctccggcgcggcggtggcgctgatcgccatggcgttacgccatcgtagcaacccgcacagcacggaagcgcgctttgtgcatcgcatggaggttccggtggtatggctggaaattttcctgctggcggcgttcttcgtcggtctggcgctgggcgatgacggcaaaatgcgggcgctggcggcggcgctgggcggcggattctggagctgatggttctggcttggcgtcgtagggctgggattgattatcccgatgctgctaaaaccctgggccaaccgcagcgtcacgtttcacggcgtgctggccgtttgcggcgccagtttgaccggcgtgctgctgctgcgctttttcattctttatgcgggacagctaacggttgcataatctggacatcttccttcctgaagccggatttctggcgctgttgttgagtctcggggtcaacgtgttaaccccgctggcgacgtggtgcgggatggcgcagcattggcgtggcgtcatgcgcctgacgacctgcggcgcgtggacggcgttcacgctgctgctactggcgtttgcgattctgtttagctgttttctgaccagcgatttttcggtcgtttatgttgcgcagcatagccatagtcagttgtcatggggactgaaactggcggcggtatggggcggtcatgaaggctcgctcctgctgtgggcgctgcttctttcggggtggacggtgctattcgcctggcgctcccggcatgaatctgacgcgctttttccgctgaccctgagcatcttgtccctcattatggcttcgctgctgctatttattgtgctgtggtccgatccgttcctgcgtattttccctcccgccatggaagggcgcgaccttaatcccatgctgcaacatctggggctgatcttacatccgccgctgctctatctgggttatggcggcctgatgaccgcggcgagcgtagcgctggcctcgctactgtgcggcggctttaacgcggcaaccgcctgggtgtgctggcgctgggcgttactcggctggtgcgctctgacgctggggatcattctcggatcgtggtgggcgtattgcgaactgggctggggcggctggtggttctgggacccggtggaaaatgcctcattgttgccgtggcttgccgccagcgcgttgctgcacagtctgtatgtcagccgccagcgcgggagcttccgccactggtcgttgctgctggcgatactgacgctgatcctctcgttgctgggaacgctgattgtgcgttccggcattctgctctccgtccatgcttttgcgttagataatgtgcgcgcggtgccgctgtttatcctttttgccgcgttaagtctggcatcgcttgctctgtacggctggcgggcacgggagccgtatccggcgacgcgtttgggcggcggaaagtgcgaaacgctcattctggcgacgctgctgctctttagcgccgtcttgttgatcgtgctggtcgggacgctctaccccatgatttatggtttgatgggctggggaaggctttcggtgggcgcgccctattttaatcgcgtcacgctgccgtttggcctgctgatgctggtggttatcgtgcttgcgacaatcagaagccgcaaagtctctgtgcatcgtcagcttccggcgttgctggcgcatacgggcgtatttatcttcgccgccgggatcatggtttccagcggcagtcggcatgaaatcagccttaacctcagcccggagcagcaggtggtactggcgggctatacctttcgtttcgagcgtctggatctggaagccaaaggcaactacaccagtgaaaaagcgcggatcacgttgtggcggaatgaaaaacgcattggcagcctgcagcctgaaaggcgcttctatgccgcgcgtcgtcaacagatgatggagccggggattcactggaacctgctacatgactggtacgcggtgatgggcgaaaaaaccggagcggaccgttacgccatgcgcttatacgtgcagaccggcgtgcgctggatctggggagggggattgttgatggtgtgtggcgcgctgctgagcggatggcgggggaggaagcgtgatgcgtaaattactcacagcgttgccggatggcggcgtaagcgccttatccggcctacaggatgcgcaaaccgtaggccggattagcgtagcgccatccggcagaaagtttttactcttaacgatcgtcctgtttttaatcacattcgccacccacgcccaggtggtggatacctggcgctttgacaatccacaacagcaggaaaaagcgctgtctattgccggtcaactgcgctgtccgcagtgtcagaaccagaatttgctggaatccaatgcgcccgtggcggtcagtatgcgccatcaggtttacagcatggtggccgaaggtaaaagcgaagcggaaatcaccgcctggatgaccgaccgttatggtgatttcgtgcgctacaacccgccgttgaatgagcaaacgctgctgttgtgggcgctgccgtgcctgctgttattgttggtgggcgtggtggtctggcgggtgagaaagcgtcagcacgcagaagagggggaacaatgagccagtctgagcactccactgtgccgttacgtcccatgcccgtaaagcgtctgacggctgcggcggtgttgatggtggctgtctgtatcggcggctatatgttgacgccgaaatggcaggctgtgcgtagcgagcaacagcgtctggccgatccgctacgtgactttacgaacccgcaaacgccagaggcgcagctttccaggctgcaagaaaaaatccgcgccaatccgcaggatagcgagcaatgggcgcggctgggcgagtattatctctatcgcaatgcgtatgacaatgcgctgctggcatatcgtcaggcgttgcgtctgcgaggcgataacgcgcagcttttcgccgcgctggcaacggtgctgtattaccagtccgggcaacatatgacgcctgcgacgcgtgaaatgattaataaagcgttagcgctggatgcgacagaagtgaccgcgcagatgctgctggcggcggatgcgtttatgcaggcggattatgcgcaagccgtgtcgctgtggcaaaccttactggatgcaaactcgccgcgagtgaaccgcgcgcagctggtagaggccattaatttggctaaattgttacaaaatcggcagaaataattttttcttttttgtgacttttgtcatgtgtgctgtttaaaaaaacggcgaatgcgccacaggtaaaaattaattacctcagaatattattcgattttgacgaagtaaaaaactttccataacaaatagttattcatcattaacaccataaactcgcgttattatgcataaaaacagccaaaagccctgttatgaaaggattgcgcaagacgctatgcaaatgatactgattatgcgcgttaaaaaactctacaaaccaacgcaacacaaatcatacccttccagtatgtattgctctcatgctttcggcggagagcaacgcttcatcgaggaagtctgttgttatgaaaaatttgaaagtcagcctggcctggcaaattttgctggctatggtgctgggcattctgctgggcagctatctgcattatcacagtgacagccgtgaatggctgattgccaatctgctgtcgcctgctggcgatatctttatccatctgattaaaatgatcgtcgtgccaatcgtgatctcgactctgattgtcggcatcgccggcgttggcgatgcaaaacagctaggccgtatcggcgccaaaaccattctctattttgaactgatcaccacggtggcgattatcctcggcattacgctggcgaatgtctttcagccaggctcaggcattgatatgtcgcaactggcgaccgtcgatatttcgaaataccagaacaccacggcggaagtacaaagtcatgcacatgggctgatggggacgatactgtcgctggtgccgaccaatatcatcgcatcgatggccaaaggggatatgctgccaattatctttttctcggtcctgtttgggctggggttgtcatccctgccggcaacgcaccgcgaaccgctggtgacggtatttcgttccatctctgaaaccatgtttaaagtcacccatatggtgatgcgctatgcgccagtgggcgtttttgtgctgatcgccgtcacggtagcgaattttggtttcgcgtcgctgtggccgctggcgaaactggtgctgctggtacactttgccattatcttctttgcgctggtggtgctgggcatcgtggcgcgcctgtgcgggttaagtatctggattctgattcgcattctgaaagatgaattgattctgacgtactcgaccgccagctccgagagcgtgctaccgcgcattatcgagaagatggaagcttacggcgcgccagcctctatcaccagtttcgtggtgccgaccggttactcatttaacctcgacggctccacgttataccagagcatcgccgccatttttatcgcgcagctatacggtatcgacctgtcgctgtggcaggaaattgtactggtgctgacgctgatggtgacgtcgaaagggattgccggcgtgcctggcgtttccttcgtggtgttactggcgacgctgggcagcgtgggcattccgctggaagggctggcgtttatcgccggtgtcgaccgtatcctcgacatggcgcgtactgcgctaaatgtggtggggaatgcgctggcggtgctggttatcgccaagtgggaacacaagtttgaccgtaaaaaagcgctggcctatgagcgcgacgtactgggcaaatttgataagaccgcccaataacggattgccggatggcgctttgcttatccggcctacagagaaagagaatgtaggccggataaggcgttcacgccgccatccgacaaccggctccgggttgcctgatggcgctacgcttatcaggcctacaacgactacgttcatcaggcaataaacatcagccatttgttagcgtttcgaactcttcgcaaccggtatcaaacccttccagacagcttagattcaaccaatgcaacgccttctgcttgttcttttcaataaagcccggttcaccgtttaaaaacatcattcccgcccagtattctgaatagccggtacgggaaatagcggaactgcgtttgaaataccaggcggctttttcatcatcggcggcaatgcccacgccgttggcgtaaatcaggccaagcaacatttgcgcatccaccgcggagtcgttatccagatcttcagaggccttttgcagcagcgagatggcttttgggtagtccggacgcccggcctgggtgttgaccaggatccgcgccagcgtaatttctcccgctttactgcccgcgttagccgccttttcagccagctttttcgcgtcgggataatccaggcttaccggattagtgattttgatttgcgccagtagcgcgcaggcgtcggcgtcgccattgtcggcggctttttgcgcccagtattcagctttgttcaaatcgccatagctcaaccaactgtcggccagaaaatattgcgcgcgtctgtcacctgcctctgctgcctgcaaatactggctacccggctcaggatctgcggcatgggcaaagaatgtcataaacaacatcaatgcaataagtggtttcattttgaattttatttagggtacggaaaagacagtataaagagatcgtatggataaaaaaacagcctccgggcggaggctgttatagggaaaatgcctgatggcgatgctaatgcatattatcaggcctacagtagacgcaggccgaataaagcattctgatgccgccatccggcagatcaacccattgcgctttcgcgcaggcgggttttcagcttgttgtactcatcaatcacatactgctcggcggctcgctgatcggcgatcggctcaacgcgtacggcgcagtatttgtactccggcgttttggtaatcgggctgaggttttcagtcaccagctcgttacaggcgccaatccaccactggtaggtcatgtaaatcgcccctttgttcgggcgatcgctgacctgcgcgcgggtgatgattttgcctttacgcgaatgaacccacaccagcgcttcatcttcaatgcccagacgcgcggcgtcggcggtattgatttgcgcatagcccggttcatcggccagcgcggccagcgccgcacagttaccggtcattgagcggcaggagtagtggccgacttcgcgcaccgtcgacagtaccatcgggtactcttcggtgagtttatcgataggcgctacccagtcgcaggtgaagaactgcgccagaccgttgggggtatcgaacttctctttaaagaggtacgaggttccctgatcggcatccgacgtgtcgcggcatggccactggatatagcccagttcgcccattttctcgtaagtggcgccgtagaaatccgggcacagatgacgcaactcatcccagatctcctgggtgttgttgtagtgcatcggatagcccatccgggtggcgatttcactgataatctgccagtcggttttcaggtcccacttcggctcaacggctttaaagaagcgctggaagccacggtcagccgcagagaagacgccttcatgctcgccccaggaggtggagggtaaaatcacatccgccgccgacgcggttttggtcatgaagatgccctgcacgatgaccagttccaggtcctcaaacgctttacgtaccgcagagagctccgcatcggtttgcagcggatcttcacccataatgtacgccgcgcgcacttcgccatgcgccgcacggtgcggcagctcgctgatgcgatagccggtatgtgcaggcagactttctacgccccaggctttagcgaacttctcgcggttttccgggaatttaacgtactggtagcccggataagtatccggcagcgcgcccatatcgcacgcgccctgaacgttgttctggccgcgaaccgggttaacgcccgcgcttggcttgccgaggttaccggtcagcatcgcgaggctggtcagtgaacgcacggtttccacaccctgatagaactgggtgacgcccataccccacaagatcgccgcgcttttcgcgctggcatacatccgcgccgcctgacgaatctcctgtgcgctcacgccagtgatctcttcaacggactccggcgtatagccttcgacaatcttactgtactcttcaaaaccttcggtacggctggcgacaaacgctttgtcgtacaggttttcttcaataatgacatgtcccatggcgttgagcagcgcgatattcgagccgtttttcaacgcgatatgcatgtcagcgatgcgcgcagtttcaattttgcgcggatcgcagacgataattttcgccccgttgcgtttagcgttaatcacatgattcgccacgatagggtgggaatccgccgggttatacccgaagacgaacactaaatcagtgttatcaatttcgttaatcgcattactcattgcgccgttaccgaccgattggtgcagacctgcaaccgatgggccgtgtcagacgcgagcgcagcagtcaacgttattggtaccaataacggcgcgtgcgaatttttgcattacatagttggtttcatttccggtaccgcgagaggagccggttgtctggattgcatccggaccgtacttcgctttgatggcgctcaaacgttcagcgacgtaattgagcgcttcatcccaggaaacagattccagtttgccgccacgctggcgacggatcattggggttttcagacgcggggtcaggatctgggtatcattaataaaatcccagccatagtagcccttcagacacagggtaccctggttggttttcccctgcgccgcctcagcccggacgattttgccgttatcgaccaccagattgattttgcaacctgatgcgcaatacgggcaaaccgtgacgactttttttatcggtttcgctccagttaatcaaatcgcgcatacgcgctgtcgccctcagtatgcatgttttatgccacttttttagtatgggctttccctgatattacgggcgaattttgctcaaaaccctgacgaaaaacaggctatcgtcagttttgacgtgtcgaaagaaaatgccgcatgacatttattatggggagaaacgcggagcgcaggccagataaggcggaacgctctgcctgaagtggatattatccggatggatagactcaaggtcagggaacgctttgagactaacgccaggatagaacaggccgcggcaggcagtttcataccgtggcccggcttcagaggaggctgaaaaggattatcgcggcaaaaatagcggcaataacgagatatttcagcgcgtaatagagagtacggtttttctttttcagccgttgcccggcatcgcgtgctgcgtgaacgtatttaaagatgcgattaatcgcaccggtgcgatcgttctcgtcgtttggcgaactggcggcggacatcaacgatgcgccgacccagtggtttacgctctgcgcccagcgccatttcattgggcgctcaatatcgcaaaagaggataatacgcgtctgctcagttttattttccgcccaatgaacgtaggtttcgtcgaagatgacggcttcgccgtcgcgccagctatggcgctgtcgatcaacttcaataaaacagcggtcatcattcggtgtgcttaatccaagatggtaacgtactgaaccggcataggggtcgcgatgttttcccagataggccccgggaggcaactcggcgaacatcgccgctttgatagaggggatgctgttgaccagctttgtcgttatcgggcataacgtttctgccgacgggtgggcatcggaataccatttaagataaaaccgtttccagccgcgcttgaaaaaggtgttgaatccggcgtcgttattggcctgcgcggcttttatgtgatgctgaagccgtagcgcctcttcacgaatcacctgccagttttccgtcagcttctgcagctctggaaatgccgtggtatcaaagtacggctgctttgccggtaacgttgagaagcgagtcatgaacatattgatcggcgccataaacgtcgagtggtcaaagagctgacgggaaagtttttgtttttccaccccgcgtgaatgcgcataaatgacgctgataataaaaataccgataatgattgctgcgaacataacgtcactgtccttctaagaaaacctcatcccgggattttcaggcaaccctcccggtgatgccaaagagaaaagtgtagttcgttgacaataaatttacatttctacaacttaaaagggccatttttgttaaagaagcgagtcagcccgtttaacctttatccaggcttgtcgacagtagaattgagatgactccgctacttcacccggtgacggctgattacgttatgccttatctcctgatgacggttgccagatcacaatgctttcgtaaaccggaaatgactttgcttgtaaccttcgcgaagataaaaacggtgtgcatcgcggcgtttaatatttgtggaaagctccgttagctccgcacccgcctgacgtgcttcttcttctgcccaggccagaagctgactgccaactttttgtccccgcatctgcggtaataccaccagctcctgaatttcgccaatccagttggcatgatggagatgaaactgcatatgcaggctgatcatgccgaccacctctccgttgcgtagcgctaaacgataatgaaggttggggtccagtaaattagcggcgaacccatccctgaaagcctgataatcaagctcatttttaagtaactcacagataagcgcgtaaacagaatcggtatcctctgttgtcgcgtggcgtaattcacagactggcataatgtcctcccgacgcttcatcaggatcaaccatctttcgccagactgtagcaaactaccgtcattatttattctatggcagctaaacggcggataacgtgcagccaaagatcactctgatggcaagggggaaggcgagcctcccggggagttaggtggcaggctgatgtttaaccacgttaatcatccacggcacaccgaaacgatcgctgaccttgccgaaaccctgcgcccagaaagtctcctgccagtccatttcgatttgcccttgtgcggcaaggttatcaaaccagcgcttcccttctgctacatcctgggtatcaagcaccagcgtaaagccggaataatgcgccgttcccgacgcgctggcatcactcatcatgatatcgctgcccgcaatgcgcatgttggcgtgggcgatagcagtatcgggaaagcgcattcctgacgggcagccctcttcattatccgccgccgaggggggcatttcaccgaagctgagtttataaagcagttctgcgcctaacgtttgttgataatacgcgatggcgtcggcacagttgccggcaaaagagagatagggacttaacggcatgatggttacctcaggtaagagatgctcgttaagtgtagttcgaaattggcacaatattgtcggtggcagggccgctcaggcccggtaagcaaggcgctaccgggcaatgatacggtaaatcagttctttttcacgaactcggatttcagtttcatcgggccaaaaccatcgattttgcagtcgatgttatggtcgccttcaaccagacgaatgttcttcactttggtgccgattttcagcatggaagagctgccttttactttcagatctttcacgatggtgacgttatcgccgtccgccagcaggttgccgttggcgtctttgacaatcagctcatcgctctcctgagcgggttccgcatcgttccattcgtgagcgcattccgggcagatgaacatgccgttatcttcgtaggtatattcggagttacattgcgggcagtggggtaatgacatgttggtatcctcaaaaagtcagcgggggcaaacgcgcccaaaaatggcagatcgccgaaaaaggccgcaattatacacaaaatccttagtgttgtcgggactattgccgcttttataaaaggggctgcgccacgccagtcagcaatggtttacactcgaataaccgcttttttactgccactacagcgcattagggcgtccttgtttacaccttttgaccaaattgacatatatgtgtgaagttgatcacatatttaaaccctgttagggtaaaaaggtcattaactgcccattcaggcgtcaacaggttcggttgtacagtccgtaaccggacagtgtaagtaaacctgctacgcttgtatgagggatagcgttcgcgcccctccctccgctcgacggcgacgctggcgcggtatgccagtgcccgccgtatatagcgctacagggcttagcctatgaggacagctatgctgaaaaggaaaaaaataaaaccgattacactgggcgatgtgaccatcattgatgatggtaaacttcgcaaagcgattaccgccgcgtcgctgggcaacgcgatggagtggtttgattttggtgtttatggatttgttgcctacgcgttgggtaaagtctttttccccggcgccgatcccagcgtccagatgattgccgcgctggccacgttttccgttcccttcctgattcgtccgctcggcgggttattctttggtatgctcggcgataaatacgggcgccagaagatcctggcgatcacgattgtgattatgtcgatcagtaccttctgtatcgggttaatcccctcttacgcgacgatcggtatctgggcgccaatactgttgttgctgtgtaaaatggcgcaggacttctcggttggcggggaatataccggcgcgtcgatctttgtcgcggaatattcgccggatcgtaaacgcggatttatgggaagctggctggattttggttccatcgccgggttcgtgctgggcgcgggcgtggtggtcttaatctcgacgattgtcggcgaggagaatttccttgagtggggctggcgtattccgttctttatcgccctgccattggggattattggtctctacttacgccatgcgctggaggagacgccagcgtttcagcagcacgtggataaactggagcagggcgaccgcgaagggttgcaggatgggccgaaagtctcctttaaagagattgccaccaaacactggcgtagcctgttgtcatgtatcggtctggtgattgccaccaacgtgacctactacatgctgctcacctacatgccgagctacctgtcgcataacctgcactattctgaagatcacggcgtgttgattatcatcgccattatgatcgggatgctgtttgtgcagccggtgatggggctgctgagcgaccgtttcggtcgacgtccatttgtgattatgggcagcattgcgctgttcgcgctggcgatcccggccttcatcctgattaacagtaacgttattggcctgatttttgccggtttgttgatgctggcggtgattctgaactgctttaccggggtgatggcctcgacattgccggcgatgtttccgacgcatattcgttacagcgcgctggcggcggcttttaatatctctgtattgattgccggtctgacgccaacgctggcggcctggctggtggaaagctcgcaggatctgatgataccggcgtattatttgatggtcatcgcggtgataggcttgattaccggtatttccatgaaagagacggccaatcgtccgttaaaaggcgcaacgccagcggcgtcggacatccaggaagcgaaggaaattctgggcgagcattacgataatattgagcagaaaatcgacgacatcgatcaggaaattgcggagctgcaggtcaaacgttcgcgtctggtacagcaacatccgcgtatcgatgaataaatttcgcgcttaaggttcgcttaatctctcgcgggcatactctcctccatacctttggaggagagcgtcatgaaaagctatatttataaaagtttgacgaccctgtgtagtgtgctgattgtcagcagttttatctatgtgtgggtcacgacgtattaaacgcctgttatgcctttttcaacagcacccaggcacgggtgcctgttctttccgtacggttttgcaggaaaaactgtccctgatgtagctgggtgatgcggctgacgatactcagccccaggccaattccgccataacggctgtccatccgcacgaacgcttcgcttagcttcccgcatttgctttcatcaatacccggcccctcgtcttcgaccgccataatagcgtcggggtcggcgctaatgtggatagtgatatgggttccttcagggctatagcgatgcgcgttttccaccagatttcgcagcagcatacgcagtaacgtcgcgtcaccgcgcaccaccacgtccgccgcgctttccggcagcaacagagtttgctggcgcgtttccagcatggtgttcagctcatcgtaggaggggaggatcacatcttccagcagttttacttcctgataattcccggaagagaatgactggcccacgcgcgccagttgcagaagctgggagacgctatccatcatctggtcaagacgggcgataagcggcacgacatcaacattgtgggtttttgacaataattccagatgcaaacgcacccccgacagcggcgtgcgtagctcatgggccacatcggcggtaaaaaggcgttcattgtcgagcgtggtggtcaaacgcgtaaccagttgattgatcgccgagacgacggactcaatctcaagcgtggagctgtgaatggcgatcggcgtcagattatccgccgtccgcgcttccagctctttttgcagttcggcgagtgggcgggtaatacgccgtaccgcctggtagcaaaccagcagcgtcaggctaaccataaatacgctggggacgatcaggctggcgaccgcctcgcgaatttcgtgcatgatatggcgatcgttgttgcgattatcccgcagcgcctgctcgaacagttggatttgctcagtgctttcatgccataaccagaaggtactgattagctggaacaccagcagaataagaccaattgtcagcgttaaacgctggcgaagggtcatcgctcttcgctgaaaacgcatcaggctcacttagctttcctcagtggcaaccagcatgtagccaaacctgcgaaccgtgcgaatgcgcgacttgccgactttgtcgcgcaaattatgtatatgcacttccagagtgttggtcgagggttcgttatcccagttgtagatatcgttataaagaatttcccggtgcaccggactgcctgccttgagcatcaatcgtgagagcagcgcgtactccttaggcgtcagggtcagttcctgtccatccctccatgcctgatggcggcctatattgagcgtcagattgccaaccgtcagttcactttcaccctggttattatggcggcgcagcaacgcgcggatgcgggcgtgcagctcctccagggcgaagggttttaccagataatcatctgcgccgacatccagcccgctaatgcggtcgttgagcgtatcgcgggcggtcagaatgagtaccggcagggtgtattttttctgtcggattcgcgtcaggaaatgcaggccatcctcatcgggcagccctaaatccagcaccatcagactgtaatgaccagactccagactatgctcggcggcacgcgctgtcgaaacgccatcacacgcatagccttcggtttgcgcggcgagtattaacccctgtaataatagcgtgtcgtcttcaacaatcagtatcttcattcgcttagtctcctgcacggttgcagaatatcatctgcggcctggtaatacgtcgtttgtacgccggttaatcccagcatggttgagaaaagattgtcctgtgaataatccagcgtgctcgcccgtttttgcaggcaggcctgatccacctgataacgctgttgataatctttagaaagccaaatgagcatcgggacatgtttttgcgtatccggcgcaatggaatacggcaaaccgtgtaaataaacgccattttcacccaatgattcgccgtgatcggaaagatagaccaggctggtggtgaatttatcctggtgagatttcagcaggttaatggctttatctacaatatagtccacgtacagcacggtattatcataggtgttgatcaactgctgttgggaacagttctgaatttcgttagtgtcacaggttggggtaaattttttaaactgcggtggataacggttgtaataggttgggccgtggctgccgatggtatgcagtacaataacgccatcgcctttcaaatggtcgatatagtcttccagaccgtgaaataacacttcatcgtagcactcgccgtcgatacattgtccgggcaggtttagctcggtgacattttgatgcggaacgcgatcgcatgcgcctttacagccgccgtcattatcattccacagtacgttaatccccgcgcgctggataatatccagtagcccttcctggtgatgcgccagctcttcgtcataatgtttgcgcggcatatcagaaaacatgcagggaacggagatcgcggtcgccgtaccgcaagaggtggtatgcgggaagtagatcacatcgtctttcgccagccgcggattggtgtcgcgcggatagccgccaagagagaaatcatcgccgcgcgaggtttcgccaacgatgagaatcgtcaggtttttgcgatcgcctttcagcattaatggattgcgatgggcatcctcgccaatgcgtaccagcggcaaattcgccagccgttgatgcgaataccatgaccaactggcgacaatactgttcgatgggcttaacgctttgatcaactgtttattatttcgaaatagcgaggcgtaatctttatagaaaaaggcggcgaccagaataactaataaaatagagatcaggacgctggccaggcggtaaagcccgctccgtaagcgcggcgtcgccggacggattttgacccagaaggcaatcacggctgccagaacgccgcttaatcccagcgtcagcaccatttgcggcgtcatcagagcaaaagtttccgcgggcgtggtatccatcatattggcgatcatggagcgatcgatgatgatgccgtaagtcaaaataaaatactgcgcggcagcgccgaccagaataaaaatgcaggccagcagtcggtttagccaaataaatgaggccagcgtcagcacactattgaccacgctaaacgcgacgaccggcatggaaataaacaccagcacattgcgcagcgagtttaacggtaggtcttgtagtacctgcttgtagaacgcaatgttcaggcagacggcaatataaaaggaaaaaagcagaagccaggcgatttgcccaagaacaggtcttttaagaaagcgctttaacatgttgatgcgtccatcgattcggtgacgctaatcgtgacaaagtaaaattaagtgaaccttaagaacttaatgttggtggtggccggataacctgcgctatccggcctgttgcgataacattaactacacgtggtcaatcttgtttaaccggcgcatccagcggatacgggtttttgtgaatgcggttgtagttcaacgcatacagcgcggtgatcaccatcaacgtgacgaacgaccacatcacttctttggcgccggaaccgataaccgcccagatgcaatatacaaacgcgacgaaggtaatcagcagatacagcgggcgcgctttaccaaagtgaccgtggcccaatagcaacagcgcggcacaggtgtaaagataaggcaccagggtgaagataaccgacacggaggagaccagaccaaactctttcgcggcgttcggcgacatactgctgaactggaagatagtcatcagcacgccgacgataagcaacccagccactggcgtaccggctttattaacccgcgcgaagatcggcgggaagagaccatcgtccgccgccgcttttgcggtttggccggcaagcagcgtccagccgccgagagagcccaggcaccccgctgccgcacagaaggaaacaatagcccctgcggtatcgcccagcgccatacgcgccgcgtcaccgaaaggcgatgctgacacacggagcgccgcgttggggatcatccccataatcgccgttgtggagagtacatagcagacggcggcgatcagtaccccgccgatggtggcgataggcacgttgcgtttcgggttttttaccacaccggccgcaacggaggcgctttctaccccgatgaatgaccatagcgtgacgttcaacgtgctttgaatcgcgccgaaggtattcataccgctcacgttccaggccgccatataggtttcgcctttaaaccagaaccagccgaagaccgcaatccctacgataggcaccagcgccagtacggtggcgacggcctgtacgcgggtaatcattttcggcccgacgatgttcagcagaacaaaaatccacagcaccgcgacgcaggtaagcgttaataccagcggatctttcagaatcgggaagaaatagctcagatagccgacgccgataacgaccatcgcgatattaccgatccagcatgccagccagtacagcacgttcgtttgatagcccaaaaacggcccgaagcagcggcgtgcataggcataagaaccgccgggactgggatctaaggacgacattttggcataaaccatcgacagcgccagggcgccgatgatagtgaccagccatccgtagattgcaatcccgccagtggccgccaggttggcagggagtaagaatacccctgaacccataatattccccgataccattaaggtgacggggattaggcccactttgtgagcatcagcatccgaagacataatttggactcctgaaaaggtgacttcgttacgataaattacgtcgtatcataccccctcagaatgccgctgaattatatcggagacgggttatcgccaatgctgttattatcgtgtcttatcgttgagtgtagaaaaattaggcagccgatcgttcccgatgttggctaacataatgcaggggggtcataccataaaactctttaaacacggaaataaagtacgacgtgctgttatacccacaaagctgtgagacttgcgagatattctttccgtccattaataattggtttacggcataacgcattcggcaggtcgtgattatttggctataactggtattctcgtttttgagctttttctttaacaagcttggactcaggcacaggcagctggcaacggcgctcagattccagtctttatgaatatcgctctgaatgatgtggtaaacgctgtcactgatgcggctgcgcagcatgtgcattaacaaagaaataaattttttgtggtcaagaaagcgggataaaacggtgaaaaggagcgcacgggtgcgttcactaacaatttcatccggtgtttccatcgcgctgtagcgggcggcgaccctgaagatatccggcgtcagacaggtggcggtcaataagggatcggcgttgcgttgccagacgggaaggtgtgagagatctttattcaggaattgtaaatagtctttaatattattgcgactcacttgtattactagcacgctatttaatgatgaaatgtcaataacgttattttcacaagccagaatggccatatgattcgcttttaaactgattggctccttaccatttactcgtaaccatgtatctttttcggttaataacactatgcaaggctcgttgctgcaaatcctcatacccgaactcctggaatatgaacataaaagaccggatctcgccaaacgggagagataacggggactgaatcaattgtgtgatgaattgaaactgcattaaaatagctttcctgaataatattacaatatttgtacgatgaattagggtgtacaaaaagttgtacgcgagtggaaacttgtcatttttgtataaaaaaagcgcgggatggggcccgcgcaaaaaggtatgacagtattattgttttgcagcaatactcagggaatacatgccatcctcaaaaaaagactctttgtgattaggctttcacgcacataacgtgatatacgccatcaataatttccgtgccttcggtttcatgctcaaagccagggaagtgatgatcccaggattgcagtgagcgtaagtaacccacctgcggactgttttcatcgccaaagttttcaccggagagcagcatcgggatgcctggcgggtaaggaataacggagttcgccgcaatgcgacccggtagattttcaatcgccaccatttcaatattgttgttcacgatcgcgttgtaggcgtcgcgcggggtaatctccgcaaccggcagggtggaataggcggcattgagacgggcgcccgggttattttcacgtagccaggcaaacattttatcgcccaggtcatgaatacccatgttcgcgtaagtgtcaggataatcctgcaccagttccggcatcacctgcgccagcggcgtattcgcgtcgtaatgatgtttgaaggagcacagcgtgttgatcagcgttccccatttcccgcgagttacccccatggagaacaggaacataatctggaagtcggtggtgcgggtcggcacgataccgtggcggccaagccatgctgtgaccagcgcagcaggtacgccggatgcttccagttcgccatcgtcgcccatacccggcgccaggatactgactttaatcgggtccagcatactccagttatccggcaggtctttaaagccgtgccaggtttccccggggcgcatgacccagcagttctggtcggttgccagcagttttgccggcgcgtcggcgaagtcatacgttttaccggtttgtggatcggtgacgacgtctttattccacggtttaaagaaccagtcgccttcatcggtaaactctttataaagacgcgccatcgcctgacggaaatcaaccgcttcgtcaatcacctcttgagtcagggacaggccgctgttaccgtccatcatcgataccgccacatcgttggatgcgcagatggcatataacggagaggtggtggcatgcatcatataggcctggttgaagcgggagaaattcaccgcgccacggccttcacggacgtgaatgtaggaagcttgtgaaagcgcgttcagtaatttgtgcgtggagtgggtggcaaacacggtcggaccgttatggtcgcctggctcgccgcgcatcgcgtagtgatcgcaataaatcgggttgaagcgcgcatagccgtaccatgcttcgtcgaagtgaatgcgatcgctggtttttgccagcagatcctgcgcctctttggcgttatagcatacgccgtcataggtacagttggtcaccacgctgtaagacggtttctgtccggctttggttttggtcagcgggctggcgctgatttttttctgcaaggtttcaggctgcatttcctgcgggtagattggcccgataatgccgtaacggttacggcttggcaccatatataccggtttggccccagtgaggatcagcccctgttcgatggatttatggcagttacgatccagtacaacgacatcattatccgtcatacaggcctgcataatagtacggttagaacctgaggtcccgacaaccacggaccaggagcggtcagcaccgaatacgcgggcggcgtttttctcgctttcgccaaacgcgccggtatggtcgaggagtgaaccgagcgtggtacgctcaatccccatatcgctgcggaacaggttttcgccataataatcgtgataaaagcgaccggcaggcgttttagtgaaaccgacgccgccctggtgtcccggcgccgcccatgaatattcatgaatgtcgctgtatttcatcaacgcgttaaacagcggcggtaacagttgctggcgataccgggtcatggcggcaacggcgcgtccggcgataaagtcagcggtgtcttccagaatccaggcgaattcatcgacaagctccagcaggtcgcggtccagcgatgccgtcgctttttccctgtcgcctaacaggaaaacgggcacgttttgctgacgctcgtgaagcttaccgatcaattgcctgacgctcaggtgctcatccggttgttccatttggtagctaaacatcagacagtcaatggcttcgttcgcggacaagatggcatagccgtcatcgaaggatgtcgatttaatgacggtaacattttgttggctcaaggcatccgccagacgctcaaccgcgttgccaacccaggtgtcctgatgcagaaactcactttcaacaattaatactttcatcatcttttacccggttgtggaggccgtgcaatttacgccttgccgacccgccgtatgaatgtgacgtgggcaagtattaccccgtcaaatagggggtgtaaagtgatggaataatggtcagttattgatattattgtttaataaacaatgggttaattattgatagcgagcaatttcacccgccgtttatcgacaggtgaattatttttttggctgatagtggtatccggctttagccgggcatcgtctggcgtcgttgctggcttagcttgcggtattgttgcggcgacataccgacaaatttgctaaaagtactgtaaaaacggctgctggatcggaacccggcagtcagagcgacatcgaggatcgttttgtcagtatcgctcaataaggcacgtacgtgattgatgcgcatcgccgtgatgtactgcttcatcgtcaattgcataacccgctggaatattcccatcgcgtagttagcattgagtttgacatgctccgcaacgtcgttaatggttagcgcctgatcgtagttatcggcaataaatcccagcatctggcttacgtaaaactgcgcatggcgtgagacgctattcttgtgggtgcgtgatgttttattgagcaaaatgggttgccagccggaaaggctaaagcgtttaagcatcaagccgatttcatcgatcgccaactggcgaatttgctcattcgggctgcttgtttcctgctgccagcgcaacacttcaaaggtgctaagctgctgggtcgccagtgatttaaccaccatcccgtgcgtgacatggttgataagatcgcgatccagcggccaggagagaaacaggtgcatcggcaaactgaaaatcgccatctggcggcagttgccggggcgggtaagctggtgtggcgtacaggcccaaaacagggtgatatgtccctgctttatctgcacgacttcattgttgattaaatactccacatcgccgtcaaacggaacattcacttctacttgcccatgccagtgactgctggccattctgtgcggcggcctcagctcaacgtccagtcgttgatattcggaatagagcgacagcgggctacgggtttgcttttcatcgccgttgcacatgtgcgggtcgggcgggaggagggatattgcttgcgtactcatcgtcactccatttcctgaattatcagaattatgcccctttagccgggaggaaaccgggaatccggacacagaatccgtcgatattgtagagcgtagcctgactatcaggccgaatactctgctttttacgccattttgtcccaaaaactcagatctcccgcgcgccagcatacgatctgagttttcgggaatgctcatcggggaagacggaggttttcaccgggaacgcgtgccaccatgaaggtgttcactactgttctggagagtcatgatgacggcacccaaaattacctttatcggcgcaggttctacgattttcgtcaaaaatatcctcggcgatgtgtttcaccgcgaggcgctaaagtcagcgcatgtcgccctgatggatattgacgaaacccggctggaagagtcgcacattgtggtacggaaactgatggactcagcgggcgcttctggccggattacctgccatacccaccagaaagcggcgctacaggatgcggatttcgtggtggtcgcctttcagattggcggctatgaaccctgcaccgtgaccgattttgaggtttgtaagcgtcatggcctggaacagacgatcgccgatacgctggggccgggcggcatcatgcgcgcgctgcgaaccatcccgcatctgtggcagatttgcgaagacatgacggaagtctgtccgaaggccaccatgctcaattacgtcaacccgatggcgatgaatacctgggcgatgtatgcccgctatccgcatatcaaacaggtcggcctgtgccattcggtacagggaacggcggaagaactggcgcgcgacttgaatatcgatcccgcctcgctgcgctaccgctgcgtcggcattaaccacatggcgttttacctggaactggagcgcaaaacggctgacgggacttatgtcaatctctatcctgaattgctggcggcttatgacgccggacaggcgccgaagcccaatattcacggcaatgaacgctgccagaacatcgtgcgctatgagatgttcaaaaagttgggctacttcgtcacggagtcatcagagcattttgccgagtacacgccgtggtttattaaaccgggacgcgaggatctgattgcgcgctacaaggtgccgctggatgaatatccgaaacgctgcgtagaacaactggcgaactggcataaagagctggaggagtataaaaccgccgagcgtatcgacatcaaaccgtcccgcgagtacgccagcaccattatgaacgctctgtggaccggcgagccgagcgtgatttacggcaatgtgcgtaatgagggactgattgataacctgccgcagggaagctgcgtcgaggtggcttgtctggtagatgccaacggcattcaaccgacgaaggtggggacgatcccttcccatctggcggcaatgatgcagaccaacatcaacgtgcaaacgctgttgaccgaagccatcctcacggaaaaccgcgatcgcgtgtatcacgcggcgatgatggaccctcataccgcggcggtgctgggtatcgaagaaatctatgcgttggttgacgatctgatcgccgcgcatggcgactggcttccggcctggttacgccgttaatctccagccgcgctggacggcagatccggcgtttaacctctactaacagaaggcgggcgctggtaacagcgacccggtaccctatgagcatctctctgacaacaaagctgagttacgggttcggtgcgtttggtaaggatttcgccatcggcattgtgtatatgtacctgatgtattactacaccgatgtggtgggactctcggtcggcctcgtcggcaccctctttctggtcgcgcgaatttgggatgcgataaacgatcccatcatgggctggattgtcaacgccacgcgttcgcggtgggggaaatttaagccgtggatattgatcggcaccttaaccaattcgctggtgcttttcctgctgttcagcgcccatctttttgagggaaccgcgcaggttgtatttgtctgcgtaacctacatcctgtggggcatgacgtataccattatggatatcccattttggtcgctggtgccgaccattacgcttgataagcgagaacgcgaacaactggtgccgttcccgcgtttcttcgccagtctggctggcttcgtcactgccggtataacgctgccgtttgtgaactatgttggcggggcggatcgtgggttcggctttcagatgtttacgctggtactgattgcgttctttatcgcctcgactatcgtgacattacgcaacgtacatgaggtgtactcctccgacaacggtgtaacggcgggccgcccacatctgacgttaaaaacgatcgttggattgatatacaaaaacgatcagctctcttgcctgttgggaatggcgctggcgtataacatcgcctccaatattatcaatagctttgcgatctactacttcacctatgtgattggcgatgccgatctttttccctattacctttcttacgccggcgcggcgaatctgctgacgctgattgtcttcccccggctggtgaaaatgttatcgcggcggatattgtgggcgggcgcctccgtgatgcccgttctgagttgcgcagggctcttcgcgatggcgttggcggatgtccataatgccgctttaatcgtggcggcgggtattttcctgaatatcgggaccgcgctcttttgggtgcttcaggtaatcatggtggcggatacggtcgattatggggaatttaagctcaatattcgctgcgagagtatcgcttattccgtacagacgatggttgtgaagggcggctcggcgtttgcggcgttctttatcgctctggtgctggggctgattggctacacgccgaacgtggcgcagtctgcgcaaaccctgcaggggatgcagtttattatgattgtcctgccggtactgtttttcatgatgacgttggttctctacttccgctactaccgtttgaacgacgatatgctgcgcaagattcagatccacctgctggataaataccggaaaacgccgccattcgtcgaacagccggatagcccggcgatttctgtggtagcgaccagcgatgtaaaagcgtgagcatggtctctcgtgcaggccggataagccggataagcgtagcgccatccggcaattaaccgataacgcggcccgggagaacgccgggcctgccaggttatttcgcgcagttagcgcactgtttgctgacaatctgctggaagaaatcgttgcctttgtcatccaccagaataaaggccgggaaatcttctacttcaattttccagatagcttccatgccgagttccggatactcgacgcactccagatgcttaatgctctgctgtgccagtaccgccgccgggccgccgatactgcccaaataaaagccgccgtgttttttacaggcatccgtgacctgctgactacggttgcctttcgccagcatgatcatactgccgccgtgggattgcagtagatcgacataagagtccattcggcctgcggtggtggggcctaatgagccagatggataacctgccggggttttggccggacctgcgtaatagatggggtggtctttaatatactgcggcaggtcttcgccggattcaatacgctcttttagcttcgcgtgggcgatatcgcgacctacgataatggtgcccgtcagcgacaggcgagtcgagaccgggtactgcgatagctgggcgaggatctctttcatcggacggttaagatcgactttcaccgcgtcgccttcgcccgcctgacgcagcgctggcggaatatactggcccggattgtgttccagtttttcgatccagatgccttcgcggttgattttcgctttgatgttacggtctgccgagcaggagacgcccatccccaccggacaggaagcgccgtgacgcggcaggcgaattacgcgaatatcgtgggcgaaatatttcccgccgaactgggcgccgaggccaagtttttgcgcttcttccagcagttcctgttccaggtggagatcgcggaatgcctggccgtgctcgttaccttccgtcggcagcgcgtcgtaatagtgggtgctggcgagtttaacggttttcagcgtgctttccgccgaggtgccaccaatgacaaaggcgatatggtatggcgaacaggccgcggtgcccagcgtgcgcattttctcaacgaggaagtttttcagcttgcctggggtgagcagcgctttggtctcctgatagagatacgttttgtttgctgaaccgccgcctttcgccacgcaaaggaacttgtactcgtcgccatcgacggcatagagatcgatttgcgctggcaggttgctgccggtattgacctctttgtacatatccagcggcgcgttctgcgagtagcgcaggttatcttcgatataggtattaaacacgcctttggagagcgcggcttcatcgccgccgcccgtccagacgcgttggccttttttacccatgataatcgccgtgccggtatcctggcaggtcggcagaatgcctttggcggcgatctcggagtttctcaggaattgcaacgccacatatttgtcgttttcgctggcttcggggtcatggagaatggcggcgacttgctgctggtgttcaggacggagcataaaagacgcatcatggaaagcctgctgagccagcaacgttaacgcctgcggctcaacgttgaggatagattctccattgaattcactgacgctgacataatcggaggtgagcagataatactctgttttgtcctctcccatcgggaaaggcgcctgatagataaactcttttttcgacatgtgcttccagcctaatagtaagaaaatgtattaagagcctcatgggccaggctctaagtcgcgcgccgcgcatagccgggcggcgcgcgcggccattacaggaatccgtacattgcggcaaagatccagccaaagacgcaggagacgctcacgccaatcaaacccggcagaatgaagctgtggttaatgacgaagcgaccaatacgggttgtgccggaacggtcaaactgaatcgccgccagatcgcttgggtaggtcggcaggatatagtagccataacatgccggcgcagaggccacgatatacgccggatcgacaccgatagccagcgcgacgggaacaatcgccgccagcgccgctgcttgggagttaacaaacttggagaccagcagcagaacgatggcgtaggcccacggatactctttgaccatttcgcccagcacgccctgaatttccgacatatgcgcgccgaacatggtttccgccatccaggcgatcccgtataccgcgacaatcgcaatcataccggaacgaaaaacttcgttttttgagatagacgcaggattggttttggtcagaatgataatgagtgccccggtcagcagcatgaacatctgaatgaccagcaccatcaacaacggtttgccgccgaaggttggacgtaagtcggagtccgcgcccaggagagcgaccacggcaatcgccgccaggaagatccacatcgccagccagttgcttttcggcagttttttatccagcagcgtcgcggtatcgccgtacacgtactgacggttttccggtacggagataaatttctgaaacgcttcgtctttatccagatctttaccgcggaaccaactaaaaataccgattgccaggataccgagcagggtagacgggatggtgatcgacagcagatcgaggaactccagatgttttccgtcaaatgtcacgttgcccagcatcgctaccagagaaaccacggcgacggaaaccggactggcgatgatacccatttgcgcgccgatagaactggccgccattggacgttccggacggatattattcttgatcgccacgtcatagataatcggcaaaatggtgtaaaccacgtggcctgtcccacacagaatcgtcagggtacaggtgacgaacggcgccacaatagagacgtatttggggttgcggcgcagcagcttttcggcaatctgcaacatcacatccagcccgcctgacgcctgcaacgtcgccgacgcggcgactaccgcgataatgaccagcattacgtcaacgggcggtttacctggctggagatggaaaacaaacaccagaatgaccagaccgataccgcccaacaacccgagcgcgatcccgccctttcgggcaccataaaacagacatattaatattatgagaagctgtatactaaataacatttttatttatcctcgcgataaacccagtcaattttgataaatggatcacagccatcttctgatttgtgtgaatgagcatcaggaaatggcgaatattcaatgcgtcagtggcgacgattaacgattaagctttttacagagttgctttaagtaattattttcttgcgatggtgatgttcagagggaagcaccctctggcgatgggcaggtggagtcagcgagagcagtaaattatgatttgtctgttttaaaaacaggcgtttattatttaatttttgtgtctcgccatcaggtaaatcacgagataaattgaacagaatgtgacttatgtgatcattgtcacgccatttttttaaattattagtatggcgtgtggagacgcgtatctgctcaccaatatacgtattgtccataggcgtagcacaagctccattgctacaaacataattttatttaagtgtcaggaaaattccggacaaatcccttttttaataaaaatacacactctcggcatgggataatacttaattaacttttgttatcgttttgaaattaaaaacagcgcatagcgctgtaataatagaaaataacgttaacaggcctgggttgagtatatttgatctgacacaatttcccaggtttgttattaatgtgatagcgtttttattggcattgttataataaatgttaccaagatataacgcttcgcgtcggctttatgcggtatccttactgacaatattgtttcagtaaagagtaatgttccggctgaacgcggtagcggtaaaccggcctgccggtcacgccgtaatgaatactggtaaacaagatatggcaattcaccagccagatgagatatttacggcaggagacgcgcgagatattcacttcgttggctaactcgtcggtagaaaattcctgctcctgatgcgcatcaatccactggcataaggtgcgtagcgtttgctgggtcagcctttttggcagccgacgaggctcctgctcgctggatgaattaccgtgaatgagcaggtcaagctcagactgttcgtaatactggcgtttttccatcgccgttttcttacgtagccagccggtcaacgcttcttcaaagcgcgtggcctgaaaaggcttgatcagataatccaccacgccgtagtgaagcgaatctttaatggtggcggcgtcagcggcagaagaaatgacaataacgtcgcttttgcagcctgcgctgtgcaggacaggcagcagatccaatccgttttcctgctgcatatagatatccagcaggattaggtcaatgtgattttcactgttgaagataaactctttcgctttttccagcgtcgaagcggttccacaacaatgaaaaccggagatttgcgcgacatagcggcgatttaactccgcgaccatcgcatcgtcatcgacaattaatacattgatcataggctggtcctttttccatcccagggtaactgtacaaaaaattgtgtgaagatcccaggctcggactccacggaaattacgccgccaagcgcttcaacctgctgtttaaccagcgctaaaccgacgccgcgttcggcgcctttcgacgagacgcctttttcaaaaatcgcctcgatgcgctcaggttcgatacccggaccgtcatcgctcacttcgcaatgcagccagccatgacggtagtgtaacgagacgctgatttcgccgccggattcctggctcaacgcttccagcgcgttttcaatcaaattacccagcgccgtaatcagcaccgtaacctgatcttcattgttattatccggtaactggctgtcgctgcttatcaccaggctgtgcccgaaatcagaggcgcgggtaatcttactgagcaaaaagccagcgataatcggcgactttattttacccagcagcaaaccgatctcttcctgatagttattggccgtcttgataatatacgcttcaagctgcttataactcttcaggtgcaataatcccagaatcacatgtaatttgttcatgaattcgtgggatcgttcacggagcgcatccgcgtagttcaccatcccgtctaaccgctgcatcagttggcgaacttctgttttatccctgaaggtggatatcgcgccgataatttcgccgttgctgcgcaccggaacggtattcaccagcagcaggcggcctttgacgataatctcttcatcgcggcgcggcgtaccgtcacgcaacacttcgctaatgtccaccacctgcggccaggcatgactcagggtggataatctggcgtcatcctgtgtttttcgataatcgagcagcgcctgcgccgcgtggttaatcaacgtgacttcgccgctaccatctacggcgattacgccctctttgattgactgcagcatcgcctggcgttgttcaaacagggttgagatctcatagggttcgaggccaaacaggatacgttttagcaccttgaccagcgcataggtgcctaataatcccaccagagcgccgaacagaatggaccagataatactgccgcggctattgttgatctgctgcgtaacgtgactgagttccaggccaatcgctaccacgccgatctgtcggtggtgttcatcataaaccggtgtgaaaacgcgcagcgctttggcaagaaagccgcgattaatggcaacgttttcctttccctgcagtgcgagcagaatgtcatcgcctttgaacggttgaccgattcgctgcgtttctgggtgcgaataacggatgccctgcatattggtcaccacaataaacaaaaagccattatgctggctcaccgcttcggagagcggctgaatgccgctttccgcaggcggttttttcagcccctcgcgaattgccggagagtccgccagcgagcgagccaccgccagcgctttatctgccagcgcgtcgcgcgtcatgctgctgatttgcgaaaaatagatcagatggaccacaacgagcaccgaaaacaaaacggcgctgaccatcagaatgacggtagtgccgagtttcatggggcgtttgcgtaacgcccggcatggcagggagtgtttcatagtggacctgagcggacgaatcgtaaggttattatccctgatgaggcgtctaattcaaaggcataggcgatgttgctccagtgttgaaaagcccgtctagtcttgcagggggcgctacctgctcatgtcgttaattaatatcgccggataccgtgatgggtaatttattttcatcagaattacataaaataatttttcattaatttttataataacgtatgcggtatcacattttatttttactgacgttcagaatgcgtttgatcacaatcaatcagcgctaatatttaatctattatgattagtttttattacatattattaataattatggaagcaatgtgagaaataaaaaatggaaataaaaaatggctgaacacaaccataacccgacgtgatgctattgtcgctactgcaaaagtaggggcggcggtgacgctaagtcaggcgattacgctgccttttgctaccactgcccaggcgcaggataccccgataccgaaggatgccaacggcgaaaccgtcaggcacagcgcctgtctggtcaactgtggcagccgatgcccgcttaaggttatcgtgaaaaatgatcgcattgtgcgtattgaaccggaagacgcgaaagatgacgcggtattcggcgagcatcagattcgtccctgcctgcgcgggcgttccagtcgctggcgcgtttatagcccggatcgcattaagtatccgatgaaaagagtgggaaaacgcggcgaaggaaaatttaaacgtatttcatgggatgaggccacagcctttattgcggcggaattaacgcgcgttagcgaaaaatatggccgggaagctatttattataattatcaatccggcgcgtattatcacacgcagggtagacccgcctggataagattactaaatctcaccggcggttatttaaattatcacaacacctattccacggcgcaaatcgccgccgccacgccttatacccacggtgattatgtcggtagccattttacgcagatcgcgcattccgatctggtggtgctatttggcctgaatctctcagaaacgcggatgtccggcggcggtcaggttgaagagctgcgccgggcgctggagacctcgaaagcccgagtcattattatcgatccgcgctataccgattcggtgattaccgaacacgccgaatggctaccgattcgcccaaccacggacgccgcgctagtcgccggcatagcgcatacgctgattaccgaacagcttctcgacgaggcgctggtaaaccgctattgcgtcggctatgaccgtagcaccttgccggacacggctgcgcctaacgccagctataaagattatgttcttggcacgggcgatgacggtatcgcgaaaaccccggaatgggcggcggatatcaccggaattccggcaacgcgtattcgccaactggcgcgcgaaatcgcctcgcgcgcgcctgctatatttgccagggctgggggccgcagcgtcatgccaacggcgaacaaaccgtgcgtgctattcagacgctgccagcgttaaccggccacttcgggcggcccggcaccaataatggcaactggccttacggtacgccgtatggcgtgccattgttgcctgtcggtaagaatccgatcacaacctctattccttgctatctgtggacggacgccattcagcatccggagaaaatgaccgcgacgacaatgggcgtaaaaggcgcggacaggctaaaaaccgggattaagctgtttttcaaccaggccggtaatactttgcttaatcagcacggcgaaacaaaccgcacccgtcaaattctcgcggatgaatcgctgtgtgaaaccattatcgtgattgaaaaccatatgacgcccagcgcgatgtatgcggatctgctgttgccggagaccagctatcttgaggcggaagacctggtggacagctcctatgcggcaggatcgcataactatatgattgcgattcagaaaaccgttaaaccgatgtgggaagtgcgcagcacgtatgacatctgcgcggatatcgccgggcatcttggactgcgcgagcaatataccgagggccgaactcaggcgcagtgggcggagatgcactatcagcagatccgtgaaaaacgtccatacctgccggagtggagcgtggcgaaagagatgggcgtgattgaccagcgtatcgctaccgagcagcagagccttgcgtttgctgatttccgcgccgacgccgaggctaatccactctccacgccgtcgggcaaaattgaaatttactcctaggcgctggcggatctggcgcaagcgtggacgttgccagaaggcgagcgaattcccgcattgccggaattttgtccagcgaaagagtcgcaccttaacaaagcattgacggcgaagtatccgttgcagttaagcggtttccataccaaagggcatacccactcgacctacagcaatgtgctgatgctgcatgaggcggtgccggatgaagtctggattaacccgattgacgccagcgcccgccaactgaagtccggcgatcgggtgcatgtattcaatgaccgcggcgtggtggagcttccctgtaaagttacccagcgcattttacccggcgtggcggcgatgccgcagggcgcgtggacgcggcttgacggcaacggtgttgatgtcggcggctgtatcaatacgctgaccagccatcacccttcgccgctggcgaaaggcaatccgcagcataccaatctggttgaaattaaacgcgcttaaggagtgatgtacgatgaaacagtgtggcttttatgttgactcctcgcgctgttcaggctgtaaaacctgccaggtaagctgcaaggataataaagatctggatgtcggcccgaaactgcgccgcgtctatgaatatggcggcggaagctgggtgaaagagggggaaagctggcatcacgacacctttacctactacctctctattgcttgtaaccattgcgatgagccggtatgtgtctccggctgtccgaccggggcgatgcataaacgcaaagaagatggtctggtcgtggtggatgacagcgtatgcgtcggctgtcgctattgtgaaatgcgctgcccctacggcgcgccgcagtttgatacgcaggcaaacgtgatgcgtaaatgcgacggttgtcttgactgactggagaacaatctgcgccccatttgtgtggattcttgcccgcagcgagcgctggatttcggccctgtcgatgaattacgggcaaaatatggcacggagaatcaaatcgcgccgctgccttcggcgtcgttcacccatcctaacctcattattaaaccgcatccgaaagcgagacccacgggcgatacggaaggcgcaatcatgaacattcgggaggtgcgccatgcatgagttaccgctggtcttttttacggtctttacccagagcgcggtcggcgcgtttattctgctgctgattggcggcgcaatggggctggtcgcgccgcggcgtaaggctatcggtctgttctcggtgatgtgcctgtttgggattggcgtcgttgtcggtaccttccacgtcgggcaaccgttgcgtgcgctgaatatgctgctgcgcgtcggacattcgccgatgagtaacgagattgtcttgtcggcggcttttgtggcgctcggcggtctgggggcgctcggtttattgctgaaccgtgcgacgccgctgtgtaacgcgttggtctggttggcggcgatagtcggggtggtcttcttatacgccgttccgcagatttaccaactgccgacggtggcgacctggcgttcatcttacaccacggcaatgatgatattgacgccgttgattggcggcggcgcgttggcggcattgtttggcgtgcgccgtctggggctactggtcagcgtgttggcgattttggtgagcttttgtctgcgcccgggctatatggcgacgctgatgagcgccgatagcgctctgaccgccgcgcagcatagctggtttaccgcccaggcggtattgctggcggcgggcgtggtcggggtggtggtctgcgcgcgcctgaaatcgagtgctacggtgctggccatgacggctgtggtggttatcgcggcggagttggcgggtaggattgcgttttacaatctgtggacgctgccaatgtagtttttgcccggcttgtgccatgtaagcctgataagcgtagcgtcatcaggcgaaatatttcaggagctattgctatgccttcccgtgctgttttgccgcgtatcctcggcgcactgttttactactcccctgagaggccggaggtgaaagcgttgttcgattgtttgccaacgttgcctgagctttacccctggcgcgatcgcggacatattgaatcactgtgcgcgtcatggtcgctaccggatgatgatgcgcttacatggcaattttccgtattgtttgaaggccagggaaagatgcccgtcccgccctggggatcggtctatctggaaaaagataatttgctgatgggggaaaccaccgccgattatcgagcttttttacagtcgcagggaatggtattcactgaccgtgaacgcgagccggaagatcagtttggcctgatgctattagcctgtagcgatctgctggcgcaaggcgacaacgtggcggccaaccggttactggaggcgcatctgctaccctggggattccgctatctggaattgctgcaacgcaataccgttagcgccttctatgcccggcttgccatcgtagcgacctgttatctgcaggatgttcagcagcaacaggggctacaacctgagaagaaacggttgtttttctaaggtattggtcaggttttgacgacgtgccgtaatgcttgtgtcgccatcgtgcccgctgttgcgtcagcgggcacagtttactattacagctccggcgtctttttgaaaccggtcagcatcagcaccaggctctgttttgagtccgctggcatgaaatcgtagtgatttccctgacggtcgccgccgatataccaggatatttccgttttcccttccgctagcgctttgcgcaccgctttatcgacatcaaccatgcgatactcatgtgaatggtttagatataatacggcatcggaacggtaattgatcgccggtttattgttccatgacacgctactggcgtgccagtcactgctggtcgggtaaaagaaaatttgatcggcgccgttcgtttccgttttgccgccaaaaaggcgaatacggtatttgaatagcgaagcgtccatattggcaggcaggggcgggatcttaaatttcaccagcgtgagcgtttccgggtgctgcgtgcgtccgccatttgtccagtcatcctgtacgtacaacgtatcgacgctggcatgaggcttgtcgtcttcgctgcttacccaggtattttcttccgctttactgtaggcgtaaggaaccgcagtgccgcaatccagtccctgattcatacacagatccgtcataaactgcgcgccatcttccgtccagccattcataaaatcggcatgggcggtataaatacttccccagcgctcttcccgggtttcgccatgcattaccgggtccatcgacaattccactttggacgtatccagcgaggagatctgcgggagtacccaggcgatgttcatattaaccgtcgggattttaaccggatagtctgcggaacatttcccgtggtcggcatagatagcattattgtggctatgtgtcggtttcaggttgacgtcatcccaacagttggggaaagcgatcccgatattaaactggacggcatcgcccgctttacgcaggccgcatatttcgcctaccttgttggtgtaacctttgccgttggcacataaaaaggtgattgcggaactggggccagtaccgtgatgatcgcctgccagtaactccagcccggccgggaatggatggagcggatattgcgctacatttgtggattgataataggtcttttggtaggccggatttacgatttcaccatcgggtaatttcatggacggtgcccagtaaccggagctgtcggctttattatcacaggtggtatcgggttgcgcgcgcaacgtctggtaggtagagaccgcgtcggtgtgggtgttgccaaaaaagtcatgccacatcgcctgattcgctttaccaaacatcataatcgcgtcatcgcccagcgtgtggtgatagccgcacacgacatgcgcctgaggaccggcatgggccgggaatgcgccagcggcaacgagcgtagccaggctgacggtaataaggttgagtttcatttttttgctgcccggttgaatagaagtgggagcagcaatagcagatcaaattacggtgttacatctcattaattatcactttttgtcatttgccctgcatacaggggcgaatttgcagacgtactatttaaataattagccgaaactaccctcctcttgattatgtcaatttacaaaaagggtacgttagtgattaaaatcgggctttttgtgataaccctcactatttcattttgcctatgctaatggcgctcgccataaccgaataacgattctatcggacatcggctttatttttaagaaatgcgttacgacatcagtcgtgacgcgatctgctatggattttttatgagattactaaaacgcgttattgtggttgtactcttgggcgtgattttatttatggtcagggacgatatacgctatgtttatcaactgatcctcaaatatggtgataaaccctcggcgctagcactgagtagctataaagcggttattcagcaaaaaccagtcgcaggagttaagagtaacctttcaggtttgacctactccgccgaagacaggatgcttttcgccgttattaataatccccctgaactggtctggttaacgacagaagggcagctggtagggcggatgccgctgcagggcatccacgacccggagtctattgcatggagtgggggcaaccagttccagataggcagtgagaaagatggcgcggtctataaaacacaggtggatattcagcgcggcgctatgcagataatctccatggtgaagcttgagggctatgacaaagcaaaaaataaagggctggaaggtacggcatgggatgcgaaaaatgagagattatatgccgcaaaagaaagaaaacccattatgatcaaagaagtagagatgagcaaaaatggtatcaccagagcgttgccttctgccatcactgcgagtgtgagcgatgtctccggacttgaataccatgccccaacggattcgctgctggtgttgtcggacgagtcaaaaatgattctggaggtcagttccgagtggcgggtgcgcgatcgattgttcctgacggcggagtggtcagggctcagagacgatataccccaaccagaagggattgccatggataatgaaaataatttgtatattgtgagtgaaccaaatctgttttataaattttcgtgtgatatacagaatgactaaaatctatttttactgtcacagcatgctaaaacagaacaaggttgttaataccatgatttgacgattgcttgatttgttgattcattgttggggatatttatgttttacttacctcagtaacggattactttgtggtgtagcgtaacggtaattgtcctcctcatatttgcggcagcgtagtctgccgcttttttttataaattaactctctctgtaataattaacagacaatgaatattattctgttttttcaggaggcctccgaagagacctcgcatggtgatgtttagttatcaggcataatcatttcatctacgccggaactcttgttgaccggattttccgtgggcgatgtacctgtaaatgttacactggcggcggcgctattaccggcgggatcggtggccgttatggtatactgattctcccccgacagaatagcggattgcggaacagaaacatgccagttaccggtatcgttatcgacactggcggtgtagtccgtatcgtcgaccgtgaccttcacctgaatatcctgatgcgcctccacgactcccttaaggctgacggtattatccagactgctaacagtcgatcccaacgttggttcggcggacggttgtgtatcaatagtcagcttaattgttgcgtgagcttctaagcgacccaataaaaggtcggtgtattgatgttagtgatattatcgcctccggcgccaatatcactattattcttcatggaacgtactggcggtgtagagtctatcgtcagccagccgatagacagcgaagaattatccatagcgtttgcggaacgatctctgaagatgatatccagagttgccttgcctaccattctagcaacattttagaaaaaattacgtaatatcgactgatatgtaaaactcattcagcatcaaatggattaattcaacatcagtagtaatatccatttttttataggctgatctcttttgtgttgaaatcgtttttatatttcgatctaataaatttgagcaacttttaacagataatcctgcagccacgtaataaataacttttttctcgctcaatgttagatcgaattttttagcgagcaacagaattccatctcttatattaatatgttttgctttgttcttatactgcattgtcagatatctcaattaacatattgatgacgagaggaggataaaaacgctaaaaattccgatggtgtagttttgaaatgttttttaaaaacgcatgtaaaataagaagcactatcataaccacacatataagccactcgagtaatattatattcactattgcgtagaagttttgtcgctttattcattcgcgcattaaggtaaacttcactgaatgaggtgtgctcttgtttcaatttcctttttaatgtggaacaactcatatagagtgagtcagaaatatccttgagcgcccattttcgacttatgtcgcttataataatattatagatgttttcggctaatgtattttgcgatagttctctgaagagagcaaatgcttcaggttcatagatgaactctgaaagcagaaatcttattaaatattcctttttatcttgggataatttctggcttttatttgaagagtgtaagaggttgaatactcttgctacgcctgtttctattggcgctaacagatgttttgtcgtcggttttgttaatggggccgaaaagtctgcatgttcatacagaaaaaaattataagcattttttattgacgctgaatctaattcaattaaattataatttaactgttcatgagtctcttccatagtgatatgaatggtttgatctttagctaaaaatattaacattggccctgatgccgtaatatactccccggacgatgtcgtaattgaaattttacccgtggtgagcttgatgagtacggactgcagtaaatttaatccctgaagtgataaggatttcctctgccagttttgcgctgattgtaaacattcaatgctccccacctggacaggtgagggattaaacacctttagcatgataatttccttttattaaatgtgcgtgtaaatcaaaaattattctgaaaaatatttcaaaagaaaactaatatatagctatataattatttgcgaacttaaggtatcaggtggcgatcttttcattttctatggaaaatgctattttatattgcatttctacctattatagtatcgttaaaaaactatgtcgcgtataaaaaaaagatggaaatatacaagaattggctcatgttattatcaaattatctctttaaaatttgaattaagtaataattacccttattcttttagagaatagctctttaatttcatgggggtagttagcatgaggtataagatctgatgttaatttgtgataaggtttatcttggaggtaaatattaacgatctcggccaggaaaggcatacaacgcggtaaatatatactgcggcgggtagacggtgtaacaatatccggaagtttgagggggaggggaaacattcaatcgtatggttggctttatgaaaaacgatgtaacacgttattgaggttcttactgtgcgtatccgttaggtttatgctttctgattatataatgttgcgtgttttggcgcggcagtattgaatcttttgctgcgtcggccccgaggaggaatcactcacagcgaatgccagcgcacagcctggtactgaatctataaatgagtagaaaacctttcggttcgctactccggttccattccttctaaatttatcgtaatgacatctgcgttacgcgtgttgtatacttaatatccacagaagtacaagaggacaacactatgccagccgcaaacagtatggcgatgaaacgtgaaactctgaacctgcgtatcaaacccgccgagcgcgatcttattgatcgagcggcgaaagccagagggaaaaaccgcacagactttgtgttggaagctgcccgtgctgccgcagaagaagtgcttatcgaacaacgcatcattatggccgatccagaggcttatcaggaatttctcgttcgtttggatcaaacaccttcacctaatgccgcactgcgtaaaaccatgcagacccctgcgccgtgggagcaggaaaaatgatctccacccctgagccgcttcatgccggacatattcttactccgttttgctgcggtgtggattctatagataactggctgaaacagcgggcgatgaaaaatcagaccactggcgcgtcccgtacctttgtgtgttgtggcagcgattcgaacgtactggcctattactcgctggcgtccagcgcggtcacgacgaatacctcccccggtcgctttcgtcgcaatatgcctgacccgattccggttgtggtattggggcgtctggcggtggataaatcgcttcatgggcagggcgtcgctcgggcgctggtacgcgacgcagggctgcgggttattcaggtggcggagactatcggcattcgtgggatgctggttcacgccctgtcggatgaagcgcgggaattttatcagtgggtggggtttgtaccgtcgccgatggatccgatgatgttgatggtgacgttgggggatttggtggagagtgtttaaactccagaacgcatcccttagcttctgatggccggaattcgctgtggatagtcagtgagccagaccggttttaccgcttcagccggacaacgacgtcatgacggtctggacggactgcaaacggggacgttgaattcatgcgaatcggggaaaccaaaggcgttctccacgcccggtcgcccctacgcagttgcacttcctttcatttgctgtggccagtttgcgggaagactttcaccttcagtaattaagttcggggcgttcttctttactcaataaattatttttgtcgttcagctcctcacggacttttgccagtgacttctgaaaagccgggattgtttgcagccttgcaaactctactgctcccacataacggccagcatcaacatcgctttgccagtgagcaccgcatatcactctgctttgcccgaactcccatcctcgtctggcgagctcctgcgcgcgttccggtctggcctgggataatactaatgccagaagtgtactataagcagtatgcccggaagggtaagagccatcttttcgcaaagtattctcatcttcaggacggcaggtagaatgattaaataagacaaagggacgagtacgcatataatatttttttgccgaagcagtagcgtagtagccgcccattttcagaagattctgtaacatattccaggtttctggcgtatctttgggattaattttagcacccactactggcgagaatattctggctatattttccacgcttatatctgcatcctcagcagcttgtttccatcgtggggaaccctttatcgcatagcccttaaaataagcctccttatcatagcggaaagccggatcatcattacctggcggtggtggtaagtagaactgactgttcactgattcttcaggagaatgaaagggttgcattgttgctgctgatgtatatttagctacgatcagtggtagaaaaaatagtaaataacgacttttcataaagactcaccccggatcaggcaataataaacagatgtgattctataatgatttattgaaatggttattcaacatacaggtaaaaaagcaggacgctgcactggcattatcgtctgtccataccggactgactgtagcggacaacagaacaatactgatacttccggctaacagcattttgtttaacttttgtccccggttattttttatctgcgtgcctgactgacacgcattaggttaaaatctttccgtaataacacagtatgaataattattttaaagtatgtgctctgttaccccgataactaccatcagtcatgatgtactgagtattaatttatgattatgaacaagagtcggaaacagtatttaagaataaagaaaccgaaaaagaaaaaatgctaaaattggcgaaggaattgttgttgtcagtgatgaaaaagttcatggcggagatattggattcacttgtcgaggctagcgaaccgtcagatggagtgatacgcgttattactggtaataatctccctgtagctaagtaagcttttgacccaggcccaaagatgagcggctgatcgccgaagcgctgggcgttgcgccagagaaaatctggccttcccgttatagctaatcaggccagagatgggggctacggatttccattcccagaaaagcaaaaacccagccataggctggattttctgaataagtggtgcccggactcggaatcgaaccacggacacggggattttcaatccccttgtcaaaaagttagacaccgctttgactttttgaattggtagcaggcaggcgaacacattcgaataaatttcgagtgtattgcatgcaaactgtatctcgcgttaagtgttccccccaggtttcaaccggggagtctgtagaaagaaaaccagacgccagtattcatttggcacagcaggtttcaccgcattcgttgttactccctgatgagcaacaattcccggtagtattgccagtagtatccactaagggcggagaagggaagtcaaccaaggcaggcaatattgcgggttacaccgccgatgctggtctgaaaacactgctaatcgatggtgattataatcagccaacagccagcagtatttttaaacttcactatgaagcaccctgcggactgtatgaattactcatgcagactgctgaccttaacaaacctgacagcatcatttcccgcacggttattcccaatcttgacgtcatcatttccaacgatcctgacgatcgtctttccaatgatatgctgcatgcagctgatggcagaatgcgtctgcgtaatgtcctgcagcatcctcttttcagacaatatgacgtcataatcgtcgattccaaaggcgctggcggggtgatggtggagctcgtggtgctcgctgcgactcaaagcgtcatgggtgttattaaaccgattttacccgatgtacgtgagttcctacgcggcactgtacgtcttttatccaaacttctggttctggaaccctacggtatccatattcccgatattcgaattctcgccaactgtgttgaacccactgtactggatcgaaacaccctcaacgaactcaaggcaatcgtggataaaggtcagtacccccagtcagaccgtattgccatatcaatgctgaataccgaaatagagcaactggaagtctacaaacgtgggcatgcgtgcgggcagccagtacatcgtctcgaatataaaactgaccgggtaagcctgccggcagcggagtccatgcaccacctggtctgtgagttatttcctcaatggaaagataagtttgatgcggttctggttaaccggcctcagcccggatttggtcagggggcggatgaggtatgagccataaatctgtttctgcagtatccatgctgtttaatgtcggagctgaaaccggtgttctgggcggactgatgctcgataacgaccgctgggatgaaattgcgccgcttctgaattccggagatttttattatggccagcatcagatcatttttcgggagatagaacggttggtcagtgctggcctgcccattgacctgataaccctgtccgaatccatggagcgaaaagatctgctggagcggtgcgggggggtcgcttatctggctgaactgtcaaaaaacacgcccagcgccgccaatatcgttgcttatgccgaaattgtgcgcgagtacagtcgtaagcgacggctggttaagctggggcatgagctacatcaactggcctcagtcggcgatgcggatatacccggtctgattgaaaaggccgaaaagcagttatttagtctggctcagcaggcctgtgaccccgacatttgtctgagcgtaacgactcaggtcgctgacacggtcagctggctggaatcggtcagtgggggaagcggtgtgaccggtacagcgacaggttttgctgaactggatgagaaaacctgtggctggcaggacggtgacctgattttactgggtgcccggccatcaatggggaaaacggcagaagcactgaaacatgccgttgctgcgctggaaggcagtcccggcaagaccgttcagttctacagcatagagatgccaacccagcagctgataatgcgtctgctttcaatgctggccagagtgcccttcgataacctgcgcaaaggtctgctgagcgaagggcagtggagtttacttgcggatgccgtagcaaaactgacctcctgggaaggacgtttgctgatagacgataccagttatcagacgccttccacgttacgtatcagcgcgcggcgtaatgtgcgtaaatacggtcagccctcacttattcttgttgattatcttcagttaatgagttgtcctggccgggagaaccgcactcaggaaattcaggagatttcccgttcgctcaagtcactggccaaagagataaggtgccctgtggcagctttatcccagctcaatcgcagcgttgaacagcgtcaggataaacgtccgatggtcagtgaccttcgggattccggctcactggagcaggatgcggatgtcatcatgttcctgtaccgcgatgaagtttataacgagcactccccggatagaggcatagctgaaatcattctgggtaagcaacgtcaggggccgctgggcactgtcaaagttcgctttgagggggagtatatgcgcttctcggagtatcaccttggttatggggaggtgagctatggctaaagcaccactgttaaatcttaataatgcgctgctacagggggcgaaggaatcatctgcagctacaaccgctgctgttgcgattatgccgaccagtgaaatgccgatggtgctgacgctcgatgaggtagctcctaatccggacaatcctcgcacaacacgcaatcctaagtacgatgaaatcaaggaatccatcagagcccgtggtctggatacggtcccgaaagtgacgaaaaacccggatatccccggctctccttatattttcagcgatggtggtaacacccgctacgccattctgcgagagctgtttgctgaaacacaggatgaacgcttttaccgcttccatgctctgttcaagccatggcctggcaggcttgaatgtctggtagggcatctggccgagaatgatgtaaggggggatctaacctttatcgacaaagcgctgggaataaaaaaagcccgcgccattcatgaagaaactcttggacgaacggtaaccctgcgagagctggcggacctgctcggacagcagggataccccattcacaactcaatgatcagccgtatggaacatacggtggaatatctttatccctttatgccggagttgctggtttctgggttaggtaagccccagatagttaatttattaaatttgcgagctgatgctttaaaaatttggcagcaatattcggtgatgactgagactgatagtgattttaatgagattttcggtcatgtctgtactcagtttgacgatccggaggtgtattccttcgaaatgttcagagatgagtttatcggtatgttggtgaatgttttaccacacccttctcttaactatgatcggtggctacttgagctggatcctaaggcacgtaaccagagaaagttatttggtgagccagaacctgtggcatctcatctggtggatgcagatcgccagacatggcagagcactgcatcattgccgggtactgcaaacgatgagaatcaacaaggcggttcctctttaaaaccgaagctgaataacgcccctgtcttacctaaacaaccagatccagataatgacaatggggataacgatgatgtgaccggcgaatggttcggttcttgtggatcacctcgtttacctaaagctgaagtccagaacgatttcctcggggggccctcagttttaaccggtgatgttattcctgatgagtaccactttattcccgacgccggaaatatcgctgtcagtgcatcagctttcgctggcgctcaggtgggattgactgcggatactccttctgacgccgttagtattgccagcgagatgccgggtctctcacttttacccacagaaccagcactttcctcagttgagtttgccaacgtagggctcgagcctgttactgatatctgggtcattccggctctgcaggatgatatcgaacatctgcaggacatggcttaccggcttgcttatgaacttgcagaggcgatgggctgtgaggttcatgtcagtgaagataaaaatgccagtgcggccgggttctctgtttcagaacacggcggagaatttgctctttttctggcagggctttccggtcacgtgccgaataaacaattcaacatgtttatgttctgtctcaacttctttggctcccaatcagcgggagatacgcctgtttttgacgatgtgcatgtagtgaagagtctgcgccttattcgtgttattcgccgtctgcgcgagctgcagagaaatatggcggctgaacaaaatgacgggaggaggcatgagcattgatgttgatgattcgatggctcagaacgaatcgcaggtaaacattgacaacaggtttgccgaaatccgggctgctcttcggattaagggacatgtatcacgacgacattgtcgggactgtggtgatgaaatccctgactcgcgccgtgagtccatccccggggtaagcctgtgcatgtactgtcaggaatggcgagaatcaggagacaaaaaacaatgaagagtctgaaaaagccccgctcacattaccagtgggtcggtgccacggttgtcaccacacaggagctgagcagtggactggcggttattcctgtcggaagtcgaggcgtagtgaatgcagcaaagcgcgggctgtcggtaatatttgatgcctgcccgtgttgcggtgttcagctaaggctgacccgtattcgtcctgagatgcttgatattgtggcatatccggaaattgaggaggtgactcgtgtcggcgaatgaaaaagttctttcacgtatcaagaagctaatggtactggccgaaaaaacaggtaatccctatgaggcatcagtggctttacggcaggcccaggcattgatgatgaaatacgatgtaaccccggcgagcgtggtaccgggagaaataacaagtgagacctgcaggaatatccccagtaatgctctttcggttccgggttggctgaatgctctggttacagtggtttgcatgaccgcgggctgtcgcagctattacggctggtatcagaacagtgatcataagaagcgtcgcagcgtaacattttacgggcttggtgaacgtccggcggtggcgggttatctgtttggcgttgtctcccgtcagttgaagcgtgatgccgaacattatctccataccgcgtgcgcacatccgttactgaaactttccactatccgtcgccgtatggatgaataccgtttgtactgggtggccggagtatggacggttctggagtcatttgaacctgaaacatcagaaaaagttctactcgaccgctggttaacacagcagcagcgcaatctgacccctgcgaaagtacggcagccggaagggtgtcgtaacgccaaaaaagtgaggcaggctgcatggacagctggtaggcaggctgagatttatccggctatggactatcgcagtgaggagcattcgcttcaggaggtatccaatggttaacgttctggcgtttattctcgctccaggggcctgtaatcaattaattgtcttggataatgaaagtgttcacgttcaggaggcgatatgactttttcacttgcacagggtgccaacagtcttttgttcaatctggttatggaactgagaggtggaaatattcggcgatgtgaggcgctggggttgaaacctgaagaaatgcgtctcctcagaagtctgacgatggaagaactgcattatctgtcaggcagccctgtttctgttttaaatgtagcaatacatcatgaaaatctaaaacgaatgctggaccaggccaatcgtgagcaaaagcgtagcgaacgaattgatcgtgctattgctcttggtgcatcaatagagatgatggggatcttctttggtctgaatgcttcagatgtcagttctaaacggcggctcgaggggatccagacacgtcagggacgttgccagtcacctgatgaggagtgtgaagcgaagatatggcgtctctggcatgaggccaatatcagcgatatagaaagtcttaactctcttgaaactatgatgcttattgcggaagaggctgatgtcagtctcacggtgatctggggattaatcaaaaactggtgtacgggggaggtagcctgatggattcactggcaccctcctttcagttttaccgtactgacccgagaaatgtgagtaaagctgtcacgtcaaaggcgcgtacactgctttccctgtaccagcagggaaagcgagtctacagccagataggacagacaggttatctcaagattgatctgggattacgctggcgtctgctgagtaaggatgcaggtaaaagctggttatttatgtctcaccagacctataaccgggaactgaaacgatgagagacgcatcgataacaacagaaagaacgatgcaaactccggctcaggtgatggaagaacccggttcatccgttcaccgtttgcctgcagatgatatcattgactacaccttgtcgaagatgcaggcacggcttgacggtacgccggggtcgtcggggcaggagcgtaacgggctgctgtttacaggtaatattcacgacgcctacccgcgggcgctaatcctggatatgcgcctttctcctctggataaaatgtgctggataatgatacggcagtatgccctgcagaacgacggcgccatcttcccctcatatgatgaacttcagaaactgctttcttcccccggttccggacaggcgtcacgcgatacggtgagccgtgcgctgaccatgcttcgactaacgggctggttgagtttgtgcaagcgggtgcgtgataccgggggccgggtacggggaaatatttacgcccagcatgatgaaccagtcagtgcgaaggatgcagagatgtttgacccgggatggctggatatggtgggtaaagcctgccagcacaaatacagagaggtcagcgacacggcctttcatgtactgaacgggatacttgatgatccgatgatgcgtcacaggcattcgcggatgacggaaattgcggaacgtctgacccgcccgtccaaggtgggtgatgttgcccgcactcatcaaaatccgggtaccggactcagtctgaatagcataaaaaatgagcataaatcacttagtccggtaaacagacccagtagtgagaggggggagaaatcaccgagtccggatagcagactcagcctgaaatcagacagttacgacagagtccggcaaccggactgcaataacgtacgttctttcacacaaagtgtgattaaaaaaacgtacgtatctccccagagtggcaaaaatgcggttgccggaatacccgaggggttcgtgtggcctgatggtctgcagtccatcctgccggaaagtgaacaacccatgctggctcaacagttgaatcagcttgcacagaaatcaccagttcaggctgaacagatcgccctcagcgtggtgaatggctggcaccagaaacgtatcagcaatccggtgggctacttgctgactacactcaggcaagcgagggcaggactgtatcgtctggaacctgctgtcactcagcctgttaagagcagatctgtcgtgccagctgagccatccgctgccgggaaaatcccgacatgctcagctgaagctgatgtccctgcaggtcaggaagtcgtgaaggcgatggtggagcaaattcgtcagagaatgaattcctctcaatgactggttaaaaaatatactttgctgccagtggcagcatggtacaaaaaatgaccagaaactgtatttgggtctgccagaaagtgtgttggttaaaaaatgagctttgctgccagtggcaacacggtataaaaaatgaccagagactgtatttaggtctgccagaaagtgtattggttaaaaaatgagctttgctgccagtggcagcatggtataaaaaatgaccagagactgtatttaggtctgccagaaagtatattggttaaaaagtgagctttgttgccagtggcaacacggtataaaaaatgaccagagactgtatttgggtctgccagaaaatgtattggttaaaaaatgagctttgctgccagtggcagcatggtataaaaaataaccagtgagtgtatttgggtctgccagaaggcttgttggttaaaaaatgagctttactgcccgagactgcataatacaaaacgaccacttattgaaaacctaatctttggattaagaattttgcattgtgacttctggcttacctgactaattatcgccctcactaaatacgttttattcgatggtgaggggttggtgatgagtgagaaagaacaggtatcagtgtccagaaaagcgggtgctttacgttcggcgctgaacatagcgttgaatactgattatgcaataaatttgtggcaggggcgtcctccggaagaagagggggaaaaggaggggaagaaaaaagagcgtcgtcagagtcttattttcagtatgccagccttcattcaaaaagcaggtcgtattaatgccgattcatttaatgacaatccgtatgctgatcagaagatgcttgagcttgagacacttttgcagtccgcttcggtcaagatgaatgaagagcttgttgcactcaagaagtcaatgtcaatgctaccccctcaggcgactatttctgaggtcaactgtgcttctcctttaaatattggagttttcagtcgtacacctctgggttatcgatgtgtatggcttctggttggctttgaccaactggcaatgcaggcttttcaggccgcgcattatggttttatctcccagcaagagcttcaccgtagccttcgacggggaggccatctaatccgtcagatctatggtgccgctcagaaatatcgtttttttcaggtgaaccgccgcgattttgcattacagaatgctcagtaccatgaggcaatcaggaacgcaggtgaaattgacgaagctgttttgttggggcaaaaacgttcctctttttcacccccagtcagtaaggagagtattgaacttctactggcggcaaatgcaaaagcagacaaagcagatattgtgcaattactgtaagaaccgttagaagaacagattgtggctgacccttctttatttgtcgctgattcgaaacgcatcgatggttaagcccgcagaaaggctggttttctgaaaggagtgttatcatgcgtctggtgttgtgtgaaaaaccttctcagggcagagatattgcgaagtttcttggcgccactcaaagaggcgaaggattcctgaatggtccgggagttacagtcacctgggctcgcggccatctgctggagacagctgaaccggaagtatatggcgaacagtatggtaagccatggcgcaccgatgtgcttcctttattaccacagcagtggaaactggtagtcaaagcggatgcaaaagcccaattcgcggtaattaaccgtctgcttaaacaggtagatgaggtggtaattgccacggatgctgaccgggaaggtgaagtaatcgcccgtgagttgctggattactgcaagtttcaggggcgtgtattccggttgtggatgtcagctctggatgatgccagtatccggtcagcgttagctgatttgtggccgtcttcccgaactgaatcgctttattatgctggcgtgggcaggagcagggctgactggctgatcggtatgaatctgactcgcctgtttacactcctggggcgtgaagcgggtatcggtaacgtactttcagttggccgggtacaaacgccaacgctggcgatagtggtaaagcgtgatcgtgaaattgataacttcgtgtcgaaaccgtacttcgaagttattgccacgatggccgtgaatggcgtgttgtttccatccaaatgggtaccggctgcacagtattgcgatgaagagaagcgttgtatccagtcgggggtagcggcacaggtggttcagttgtgtcggcaaacgccaacggctgcgataatcaattgccagatcgagaggaaaaaacaatcagcgccgctggctttcagcctgagcacactacaacaggcctgctcccgacactgggggatgccagcccagacggtacttgatatcgcccagaagttatatgaaacccacaaactgacgacctatcccagaactgactgtggttatctgccgttatcgatgcgagaagaaatcccacaggtactgtctgctgtggtcggaactgatccggcgctacagccggtggtcgcgagtctggacactcagtttgtgtcacgtatctggaatgataaaaaaattaccgctcatcacggtatcattccgacaaaacatactggtgatctgagcaaactcagtgatgctgagcgcaatgtctatcagctggtcaggttgcactacctggcccagttcctgccccagatggaaattgacgtgactgaggtcacatttaatattggcggtcagcttttccgtacccgtggtaacgttttggtgaaacccggctggaaatctctgtttggcaaaatgtccgaagatgatgaggataatactggtgaaaccacactgcccgccatgcaggcgggccaggtctgccaggtgcagggcgctgagcagaaggtactgcagacaaaaccgcctgctccgtacaacgatggaactcttattgccgcgatgaccaatgcggcggcgttcgttactgacgccgcgctgaaaaaggtgctcaaagagaatgcggggataggaactgaagcaacacgggccgggataatcgacacgctgttgaagcgtgggtttctggtgcgtgagaaaaagacgcttaagtcaacacctcttggacgtaacctggtggatgtgttgccaggaacgttaacgaatcccggacttacggcactgtgggaacagatgctggatgaggtagctgcaggcagggtgagcctggatgactttatggcaaagcaaagtcagtgggtcagtcagctggtcgctcaggggagatcacagccactgactatgcaggcgccaccttcaccaccctgtcctgtatgtggcggcaagacgttgcagcgcaatggaaagagtggcttgttctggggctgcctgaaatatccggagtgcaaaggtatcgtgaacaatggtaacaagggccccagaggacgcagacgaaaaccttcgccagcctagaatactaacgggttgttttctttcgctgaattctggtagccttatatcgctttgataagagcagcacccatggctgtggaacggttcgaaagctttgcatgcctttcgcaactccagtcaggagaacgatctttactcgaaggatccgtcctcaaagcgcaatcactccgtgaaaaccgcgctgagccattgaccggcttcggagatttgattttacctcatgttctggtgcaacagtttggttgagaaatggccttcgcgttagcgagggccatttttttatggcgagacaaaaaatatttaacgggttgacagggttaactaatgttctaaaaatggtcgcgaaccttatgtcgcttagcgaccaccaatgttccagtgatctgagaggagcgccttcgggtgatcacaacaccaatgttccggcaatctgagagggacgccttcgggtgattgcacaccaatgtcatcgtagcctgagaggtgacgccttcgggtggtacagccctttaatctttggaaacggctgtcgcagcattttgcgatgaagatattttaaacttattgatcatcagcgttttgccagcgttgatatccctgcgggaatccatcatcccgccagggtagatgttttctccgcaacgatttcattccatggagaaacatcatgtctaaagaaactaactactttaatctgaatatcaacggtctgggctatatcacgaatgtacgtcaggttgtcaacggtaacagtaagtttacctgttgtacgctgaatgcccttagtggtccgacagataatgcagactacacccgctttgatgtcacagtcgcaggcaaagacgcaacgagtttaattaaccgctgccagaagtcctgtgatgaggacaaaaaagtaatgatcggttttgttctcagtgggatcaaatccgatatttttacccttgcaaaaggtgatcatgccggtgaaaaccgtgtcagcctgaagactcgcctcatccgggttgactggataaaaattgacggtgcaattgtctataaggcagaaaaaccggattccactcctccggcccagagccagcccgcgcagaagcagtacgcggaagattcgttctgagttctccttaacccttcctgatggaaacacactttccgtcaggaaggtgtgttcctgacttaatgtaaaaggaacaatcaatgttaacttcaccatcatcttctactggtttactggcagcaaaatttgccgggttatccttacctttacaggtccttcgcagtggtgccggatattacatcggcacgcaaaatgaagaagggccggtatcccgtgaatctgttgagtacttttccactcagtctcaggcagaacatgcgctcaaacagggcacatggtcacagcgtgaacaggcttaaggagagatactcatggcttctaaaggtgtaaacaaagttattctggtgggaaatctgggacaggatcctgaggtgcgttatatgccaaatggcggtgccgtggtaaacctcagtctggcaacctcagatacctggacagataaacagaccggtgacaaaaaagagcgcactgaatggcacagggtggttctttacggcaagctggccgaaattgccagtgagtatctgcgtaagggctcccaggtatacatcgaaggtgcattacgcacccgcaaatggacggatcagtctggcgttgaaaagtacactacagaagtggtcgtcagccagtcaggtacgatgcagatgttgggcggacgaaatagtgcgggaagtgggcagcaacagggcggctggggtcagcctcagcaaccagcagcgccttctcacagcgggatgccacctcaacagcatcctgcaaatgagccgccaatggacttcgacgatgatatcccgttcgcgccgttcgggcacagtgtggccagacatgcgctttatgtgctgtcctgaaaattgtcgctgaataatgccttcctgtggaaggcattatgttttgaacatatgaaggatacggaatggataacgaaaagggtcataaccggcccgggcacgatggcctgtttaagctttttctgcgtgagccggacactgcgagggatttcctggcagttcatcttcccgcagatatccgcgcgcaggttcgtctcgatacgctgaagcttgaaccgggtagttttgtggatcagaagcttcgcgaactgcactcggatgtactgtattcggtggaaaccgcagaaggtcacgccgggtacatatactgtcttgtggaacaccagtcgaccgcagaccggatgatggcctggcggatgatgcgttactcgatggcagtgatggatgcccacctgaaaaagggtaacgggacactgccggtggtggtgccgttactgttttatcagggaatggtgcggccttacccatacagtacagactggatgaactgtttcgatgtaccggcgctggcgcgagaggtttactcccgaccgtggcccctggtggatgtcagcgtcatggaggactgcgacctgcagtctcaccgtcgtatggcattactggagctggttcagcgggatatccggcatcgcgacgctgcatcgctgctgcgtgatgttgtacagctgatttgactagccggaaatacccgggcgcaggtggaagccgtcctgtgttatattatctacaatggcatgacaagcgagagtatcacgccgtttttatacgaactggccggtgagatcccggagtataaggagttgatcatgggcacaattgcacagcaactgaaagaagaaggtatccagcagggtattcagcagagtattcagcaggagcgtcaggccagccttgagcgtgagcagaagacgttactggaaactgcgtatgccttgcttgacaatggtgtcagcctggaagtggtgattaaatccacaggtctgaaccgcgagacgctggaacaaccgcgtcattaacatcgagggttatcgaccttctttacattgagtaaattcatgtatgcagaatgccagcaatgatgctggctttttttttcatttttgcataaagagttgtttattgagcgctaagccaaatctccgcacgattgccgtaattacggtcatccacgggatttttcatgaacacacaagcgcttttctgcctgagcctgccgctggtgattgccgggtgtgcacagcagacctccacccaaaccgctcgcgacagcgcatttgcacagagtcagcagccttccgtcttctctgatatttaccagcgatcaccggaggtgactcgcagcgggcgttacacgctggtcagtattaaaagtgcggatgcgcagcgggaaccgctcaaccagctcatcgatattactatgccagggcaactggttaactcagtcggtgacggatttcgctacctgctgtttcagtctggttattccctgtgcggacattatggtgctgacttttctgagctgctgaaccggccgttaccggccgttcagcgcaaaattgggccgatgcgactcagtgaggcactgcaggtggtcgccggtcctgcctggcgaatgtccgtggatgaagtcaaccgggaggtctgtttcgtattgcgtgatgcatatcgggtacaggctaaaactaaagcactgacatctgtcacacccgccgtgaccggcgccgcaagaacctcctccccggaaaccacccgcaatccttataccggcgttctgccggggaataaagctgaacccgtgatcgccggccagcacctggcggcgaagaaaggtactgaactgaaaccggtcagtcagtcacttcctgtccctgccctgagacctggtgggacaccggtaacgtcaggagtgtcctctgccccccccgtgaaacaagtctcttctccggctccgcgcaatccgttcacaggaaaaaacctgaccgggaccaccctgtcggcgtctcattcaccggcgcctgtgggaaagaaggctcaggctaaaacaccgtctccctcaaccgttaaggctgtaaatccggcgacggctacggtactggccacgacaacaaaaccgttaaccggtacgcctgtagctgcagtggccagtggccctgagtggaaggcggttgtcggcagcacgctcaaagagtccctgactgactgggccggaagagctgactgtccggggggaggacactgggtggttatctggcagacccctacggattaccgcattgacgcaccgttggtatttaaaggcaactttgagacggcgctggttcaggtgtttgacctttataagaaagctgacaagcccttatttgctgaagcttcccgcctgcagtgcctggtttcagttgcggataaaccggctgaccggtcgtagctatgggctggttcattgtcgctctgggcacagtatttctgcttgtcgtcggacatgtccagaccactcagcgaagcgaggttgtcaaagcgcagcagtcggggagttcgtatctgttggcccggcaaatgttattgctggctgcgggaattaatgactggcgctaccgacataccctgacggacggaacggtcgccttgtcagaactggccctgccggtggctcctgacagccgtatccgacatgtcattgtggctaaccggctgtgggtctggatgcctgaagtcccgggtctggtggatgcgctgcgtgaacagtcaggtgggtcggcattaactggcacggtgacgcaggggcaactggtctggttatccggtatcggtaatggaccattcagtgcccgcgtggtaccggacgactgacctgctgccagcgcatcgggtgaaaaaattaccctgacgccgcaaagcgcagtgattcgctctccaacttccggcagagtcagtccgtcccgtgccagcgttatctgacagtcagggaagttttcctgagggataccccgtgacactgtcgggacgggtttgagattgacccagggtttatccgtccagaccagcgctccctgtgaggatcgcatctgctcactgacatgaccgcgggcaatatcaccgctggcttgcgcactgcgcgacatcctgtccatttcctgaaaagtacaggccggcagcgaaagtgcggcgacgatggctgtagctgcaatacggagcctgactttgtaatattttcttatcattaaagattttcctaattgaggtagaccacatccccgttctgaatacctgccggtaaaggcaaccccgaagccacaccggataacaatggaagaattccgttggatcaactgggcggcgctgttgattcggcacgcgcgaccgccacaccagtggtactgagtggcctgcgctggcaggacaaactgtccggtctgctggacatgatttcggccaggacaggcctcaccccgcgtatggataacggggcaattctgttttcactcctggagacgcgtactttccagttcacatttctgaataccaatattaccagtaatgccagtgttacctcgggttcaacaagcagtatgggaaccagtggtggcagtacaaacagttcggtgtcaggggattcaagctcttcgcagcagacgacggtcgaccagagccgtaatgtctatgacgatatgaaaaagacgctggaaaccatggtgactccgcaaaagggacgtttctggctgtcggccagtaccggcactctgacggtaacggataccccttctgtactcaacagtatcgcggcgtatgttgagcagcagaaccgtcagatgaaccgccaggtcaggctcaacgttcaggtactgagtgtcagtacttcacgtaaggaacaactgggactggactggaatatcgtttacaagtccctgcgctcagccggtgcttcactcaataatgtaagtggtgatatcaccaacgcaacgtcggcgtcggtatctattctggattcagcaaccggaagtgcggctaaatttgccggctccagtctgctgattaaagctctgtcagagcagggcgatgtcagtgtggtcacctcgcagggtagcgtgaccacgaaccttacacctgtacctattcagatggccgaccagacggtctacgtggcacagagttcaactactaccacaaccgatgtgggtgcccacatccctgacgccgggtatgatgactaccggcttcaacatgacgttactgccactgattcaggatggtggtgacgtgcaactgcaggtggcattcaacctgtctgacccaccgactattcgtaacttcacgtccaaagacggcaactcgtacatcgagatgccgtacaccaaactccgctcgctcagccagaaaactaaccttcgcgcagggcaggcactggtgctgacaggttttgatcagagtaatacccggatgaccaaaaacggcacctttaccccgggtaatttcctgctgggtggcggtcgggacggcgatgattctcgtagtacgctggtcattattatcaccccggagctgatggggaacggtggctgatatggcagatattccgttatccggcaagccccgtacgcaggttctgcgctggcagcgccagaactgggtagcggggcttcgctgggaagaaaagcaaaagtcggtacgtcgagcccctgtacaacgtcggggtgttctgaacgttgtgttgacggtgaagcagggcaagagccggttgaccgcgttggggcaaattgaggccggctggcgtcaccagaagctgtattccctggcggcgctgttcagccagcagtgtacacccaatggctatggggtataccagcttgatgatggcagacaggtctttctggccacggtgaaggggatgccatctccgatggcagatgtgatcggaactccagatcaaatcatccgggcgagagagctctttctgtccttcaaccctgctcctgaggacggatggacgataccttcatcaccggaattccccttgtcctggaacactttggtcggtcaggtatcttcggcacagctccggtttgccagagtggcgggcgtgtctaatcctttgcggccatacggggcgggagtgctgtcagtggctgccctgcttggtggtgcagtctggtggagcaggttacccgaacctccggtcgcgcctgtcgtgcaggagttaccggcaccggtgcaggacgtgtttaaaaaaacacctgaacctgtttaccttccacatccctgggcagatatgcctgtggccagacactttctgaaccgctgtcagcgctggcgcgccgcagttcctgtaagtcttgaccgttggcgtctcgaacggattcgttgcagtgctgaggggctggagacggtgtaccagcggcagcccggtgggacggcggcaggctttgcggagcgggtgaagcaggtttttaagcgtacaccagtattcaaccttgtttcaggtggcaacgaaggtgtggtgtttattccatgggcgaaattcacattacaggatgagactgcgccggatgcggggacccagttgatgcaggcggtgtcgtggtttcagtcacgccaggtcagtttttctctgtccgaagtgaaaactcctcccgcgatgcccggtgatggtgccggcaacgatgcgccccagccgatacaggactggcatgaatacacgttcagtatcactgataaacacatgcctgagtggattttacagggactcgatatgcagggggtacggctgagttctgtgggttacaccctgagtcctcagggacagtttacttatcagattgaggggcatctttatgcttatgccaaaaaatagtgttttcatcagtggtgttctcctgatggcgttcagcgcaggggcattttcgcagcccacactcgcagttcctccttccgcagaggtgatttctgcaatgcctgccagtgaacccgctacggaagcagcggcatcgatatcctctgcagacttatcagatacagtccccattttccccggtaacagcgtgacggccggacagctggaggcgctgcaggggaaaaacctgctcctggaggcaaaggttcaggcagcccgactgctaaaagagctgacttctgcacaaactccgggggatgttggcaatgtgcccacgaccagtccgttcgttatgggaatgccggcagagatgaatgcgactcctgttcacaccccccctgcaactggacgaattacggttctggaagtgagtggccgtggtaacgccctgcaggccacgctgtcatttccggatggccgacaaagcctggtacagacgggaagtgtgattccggggacatcactgaaggtgaaggcaataacgctctcatccgtcacgctcagtgacggtcagcaactgacgttttagggacgaattatgtctgaacacaacgatgcggttctgctttaccacaacccggacaccacgatcctcgagctgctggttgacagccagcggcgtaccgacgtggcggtgcagcagaaggtaatgtctctgatggaggaaaaccccggtgtcacaatgaggctggtaacccgttcagagttgctcaggtacagtgaaatggctcgccagcagtcagagaagggagaaaaaggacttcgccttgaggacatcaaaaaagaggtcagcagccgtcagggcgatgttctcaactattttatggtcgcgaaagatatcggcgcgtctgatattcacggtaccacccggccaggactgacgcgcatcgagatgcgtgtgcacggtgaactggagaccgtttcggaactggctgaagaagacggaaaagcacaggcggccactatcatcctttccatgtgtgatgtgaccgaaccccagttctacgccggccgaaaacaggatggtcgtgtggctgcaaagtttctgcgaaaggtggggttatttggcgcccgttacagccacaccccgacagcagatggccttcactttgtgatgcgcgtgatcccggatgatggtgatgtggttcccacgctcgaaaaactcggttttctgccgaaacaaatccgcctgataaagcgcactttgcgcctgccagaagggatgattattttgtccggcccgaccggagccgggaaatccaccaccctgcgtgcctgcagcgacctctatctgaagcgtacccggtataaaaagcgcctactgacggttgaagatccgccggagggacgcatcgttggggcaatacagacttctattatctgtgacaaagccgatgaggcggaagtcaggctggcctggcagcgggtgctgacctcagcgttacgtctcgatccggatgccattttacctggtgaacttcgtgaccttatctccattctggccgggatttttgccgctcagaccggccatctggtgctgagtaccctgcattcaaactcggccttttccatccctgagcgaatgataacgatgggtgcaaatgccggactggtggcagatgcccagttgttggtcgggcttatcagccagcgtctggttcaggtgctgtgtcccgagtgccgtattccctggtcggttaaaaaagaacatctcaccaccgaagaacgtgaatatctggaaaagtactgttcagtggagggggtttgtcagcccgaaaatcttcatttcagaaatgaggaggggtgcccgacctgccggaaggcggtcattatcggtggcaaacaggtggcaacagtcggtaagggggtggccggacgcagtgtggtggcggaggtggttcgcacggattctacgcttttcaggctgttattacagcagggtaaggaagctgcaaaagcttactggatccgtgaaatgggggggattacccgtcgcattcatctgcttcacaaactgaatgacgggctggttgacccactggatgccgatttgattattcctcttgatgaggatgaggtgatgcaggtggtaagtgatcaggttgcatcgtcgagtgacattgatacgtcgctgattgaacgccttgccatggtaattgcagccagcgtcagagaggggatgaagcagggtgttgaggaagccattaaagaaggcgttgctgccgggatggctgcgctgaaggaggttgcatgagtcctttataccgtcttcgccgggcgctggcgcgacgtttttttacgtccggataccgtctgcgtttttaccgcatgctgtcgttgcagatgagaaatggcgtgaagttgttagaggcgctggagcaaatcagcaatatgtataccgattttgggcagcggactcatggtttcggttttctggtggacgactgccgggcggcactcactgacaacagcggggataactcccttgagcatgctcttgcaaactgggttccggcggaggaggcggcgctcatcagcgcgggtatgttcagtggtcggttacctgaggcgctcgcagaggcggaaatcctgattgactgccggcggcgtatccgacaggcgatcatgaggatggccgtttatcccctaggttgcattgcgatgctcggtggcacgctgggtgttattcagacgcagcttattccaacgctggccgggatgtcagatccgcagacatggaccggagtgctgggaagccttaacggcctgctgattttttttactgagcatggcgtggtgatgggggccgggctggcactgttggtcgcatggaccaggtggtccctgtcgaactggatacgtccggaccgtctgcgtcgtcttgcggacagacatgtaccctgggcggtttacagtgatattcagggcgcgatttttctcatcaatatgggggctctgctgtgcgctggggtcagaaccctgactgcgctgcaggttatccaccgctttgcttctccctggctcgttgtacgtctgaacgcagtgatggaggaagtggaggagggggcctcttttggtatggcgctgcgtgaatgtggttatgccttcccctcaaaagaagccgtgaactatctctctatggtcagtggggacggggccgctcagatgattgcgcgctttgggcaggaatggctcgaggaaactgtgaagcgagttaaccgacggggaatagccgtgatgctgttctcaatggtgatgttatttgcgcttattggcgttgtggtcgtggcggtgattgaggcgatttcgatgaccgagagtatggggcagtactgatgttaagcaattcaatgaaaaatgaaacagagggaaagatgatgaatgaggtatcaacattaaatccatgcaacaggcctgaccggggaatgtcggcagatgccggtgccactgcactgtttattctggtgatcattggggtgatagccgcggcggtctggtcgatgtggggtaaaaaggatgcgggtacggagctgacaaactatcagaccctggccacgaataccattggcatgatgaaaggcgttgacggttatgcttttaccagtggcgctaaaatgaccgacacgttaattcaggccggggcggcaaaagggatgacggtcagtggagaccctgcttccggttccgcgacactgtggaactcatggggtggccagattgtggtggcgccggatacagcggggggaaccggatttaataatgggttcaccattaccacaaacaaagttccgcaatctgcctgcgtatccatttcaacaggtatgagccgttcaggcggcacgtccggtattaaaataaacggcaataaccacaccgatgcgaaagtaacggcagaaatcgcgagcagtgaatgcactgcagataatggccggaccggtaccaatacgctggtttttaactacaacggctgaggaggcgggatgtgtggatatttttcccgactggctttattcatgacgctgtgcagtgtgccgctgtgggtacaggcattctgctttgatgccgctgcggcgaaataccatgtctccccgctgctgattaagtccatggccattggtgaaagtaatcttgatccgcatgcaacaaatgataaccgggacaaaaaaacggggaaaatcaaaagcacggattatggactgatgatggtgaattctacgcatattccccgtcttgtctcgatgggggtcatcagggacaaaaatgatttgctgaacaaaccctgcctgaatgtgcagattggaacgtggatccttgcgaaacattttcaggtctgtggggtgagctggaactgcctgggctcttataacgcaggtttccggcctgaccggcatgaaacacgggagcgttatgcaaaccggatctggaaaatttatcagcggcaaacgggggctcaatgacagtctctcttatcggtaccatttttcctcctgtgtatgccatacctgcttttatcgggtgcgccattttcggggcggtacttttaaggccggtacgtctttatctggccgcagcggaggtggatatctcacgccattgtgccgtcgtggtgggtatctggctgtttgcggtaacgggtttgctgatacttatggcacctcaggtctggatgacacgtatcggaatgctgtttatgtgcagttttttgctgcaactgggagtgatggatgcgaccagcggttggttgccccgaccgtttaccgcagcctgtttatgtagcggattattgttctgtctcgcttttcatcgggagccggaacttcgctttatggaaactgcggcgatggcggtggtgatggggtctatttgtcacggtgttaaccgacggcgacctcagcttggcgtgggagatgtctggctggtttgtgccctggtaggctggatgggggtaacggatgcactgcaggcggcgttttttgggctgagtggttttatgttgtggcagtggatagtccatcgggactttctgcgttgtggggttctgggcccctggctgtgtgcagggtgcataccagtcattgtggataggttgtaccagcctgagtggatactgagatgaaaaaacaaaaacatgatggcggctttgtggcgatgagcgtgggagccgggttactcattgttctggtgatggcctcgttggctgccagatatatgggagattatctgaaatcccgtgagtggcaggttgtggccatgcaaaccaatcgtttcactcaggcagtctcatcctatgttggaaagttttatccgacggtgctggcatcagcgaccacaactacacctgcagtggtaacaactcaaatgctgaagaatacaggtttgctgccggcgagctttagtgagaccaacagttatggccagcagtatcaggcgatgatagtccggaatcagcaaaatcaggagttgcttcagggcatggtggtcagccgcggtggtcatgctatgccttttacagcgctaagccagatctcgaaagacattaccgccggcttcggaggatacgttgaagacgggcaaacggcggtgggagcgatgcgcagctggcgaattccgctgtcctcctacgggaccagcaccggaagaggtcatctggccgtcatgttgagcacggatgacctgtcaggggcgcgtgaagacggggacaggctgtatcgttttcaggtcaatggtcgtccggatttgaacaagatgcacacagctattgatatgggaggaaataacctgaatagcgtcggcactgttacggccagtaatgtggctggccagaatgggaattttggcgtaagtctggtcagtaatggtccgatcactgcggggggagatattcgaagcacagggggatggattgtaacccgcagtggtaaaggttggatggatgagacccatggtggtggtttgtatatgtcagataacgactggttacggatcctgaataacaaggggttttataccggtggtgaaattcgcggtgggaagattcgctcggatggggacgtatcggcaggcggtattttaacgctggataagattaatgttgccagcactgcttgtcctgtaaatggtgcaataagtcgtgatacagcaggtgccacactttcgtgccaatccggtatttggagttcttatcggctgaactttaatattcagacatttaacgtcggtaaaaatgtaagaaatcagtatattggagtgcatgcctactgcgcatggacatatctcaatggttcacctctgggcgggtttcaggagatacactcgaacggttccaacggctggtatatctctaactacagatgggggaactacgaatccggaggtactatttcggtaacctgtttgaacttacctggcgccggattatgaattaaagccctgcacccggcagattcaggcatgttacggaaacagtcgatcctgtttgaaaacctccgtaaggggtattcgtgacataccaagcgttccctacattgtagaccctctggcgcccccctagaggagcagaaaatagatgtgtccaactgcaataagcatgaatgcctatgtactgcgcattcacattctgccctatgtcgtagagctgtgtagtgaatctgttttgacccgacacccagataccggattggcacgtatgtccttacgaggattgagggtattagagtttttcgttacggtggagaaaaacctcaattcttctcgcaaaggtatctgcaatgtctcgcccacaacgcataaaaaaaatgtctctgtcgaaagcccttgataaatactacgccactgtgtctgtgcataaacgggggcatcagcaggaattctatcgtgttagggtcattcagcgacatcctttggcagagaagatgatggatgaaatcacgacagtggatattgcgtcttaccgcgatgatcggttgtctcaggtgaatacgcgtaccggccggtgtatttcaggaaacacagtccggctcgaactcgctttactgtcatcactgtataatctggccagcgtagagtggggaacatgcagaactaaccccgttgaaatggttcgtaagccaaaaatatcaggaggacgagatcgacgtttaacatcacaagaggaacggcgcttatcccgctacttccaggaacagaatccagcgcttcacgccatatttcacctcgccattgaaacagcaatgagacaaggagagatcttgtcacttcgatgggaacatatcgacctgcagcatggcgttgcccatttgccaatgacaaaaaacggcagttcgcgagatgttcccttatcccgcaaagcgcgtcatttgctacagggaatgacggtcgcacttagcggtaatgtttttcactattcatcatctggttttaaaagcgcctggagggtggctctgcagcgcctgaatatcgtcgatctccattttcacgatctgcgtcatgaagcaattagccgactgtttgaactgggaacactcaacgttatggaagtggcggctatttccggccaccgttccctgaatatgctcaaacgttatacccatctcagagcataccagcttgtcagtaaacttgacgctcgccgaagacaaacacaaaagattgctccctattttgtcccttatcctgcctgtattgaatccgttaatgaaggatcagatggctgttgtggttttcgtgttcacctacccgattttgacaatctttcagtgtcagcggcatcgagggagagtgcgctggaggctgcaggtgttctgttgctacgaacgctggctaaagcggctcagcggggagagcgtgtgcctcgccccggggatttgccggaaggcaagcatgagcgggtaatgatccatcctcttttgagtgctgcctgataaatttgccgttacggatagtcatttacgtgatttattctcgtcgttaagagggtacgctgctgccgttcattttctgcaaaaaaggacagaggggtggagtacgctttgtttgtgatgttctgtctggcgctgtattgcccgtgttttacgttaattgcgctgttcacgccctggaaagggtttgctgtattcagtgtaacgtatcgtcgccgtcaatactgggctgtacatcttgccttgcttgatcgggtgggggcgatgaaccgccgccaggcccgacgctatcaccaggcatttgttcaggcactggagacagccctcgtggcgcggccggtgcgtcccgtttttttccgttcacatcttatgcggccagctcaggtagcgcttacctgtcaggttctttcacacaggacgggatatcgctgtcggatcgctcccattacgcttccgcgctgggaacgtgttgctatttttgcgcaaatgctgctacaggagtggcggcttattcaattgccttctgaggaggggataatggtagtcattcatcggttggcggaataaatatttttttagaattatatttttcagtcgatttcacgtcgacatggttttaatcttcttcatacattagaacaaatcgaccgaaatattccattatacctgatgaataaatgagattaatctttctattacattggaacgcagaactgaaaaaatgaaatgagttgaattttactcttttgtatccaggaaaatatttaaggttgtcagtatgaatgcaacttataacgcgctaattgcattaatgcgatctggtgaaataccacttgaaacgggggcatcagtatctgcacccagtgcacagttttcagtaagaatacggccggaaactcgggtatttctggacaggtgcgcagagcatctgggtatatcccgggccgctatgtttggtatgtgtattgatggcattgtagcagaggcgagagagagtatagcggacagaacgtccacgctttatgagcgattctgtctgctgttggatgctcatggattgaatgttatcgaacaggcacagctactggcttcctggggaataagggccagtgtattagcgagtcaggataggacgcttgatctcctgaacaaacctttgctgcagcaattgtcgacatggtttgatgtggatgttaactggctgctgggaaactcttcctatccggtagatatggctgacggccagcgcgactgggctgtgcagaccccctctctgttatgccgtctgcagtcaattcagtcagtggatccggttgagttaattttcttctggcagcaggggcgtaaacctcaaagtgtggggttgtgtctgcgctatcgcccccttatttcgggtgagccgatcgggctcctcagggtatatcaggcactagactggcaggatgagcaggttcagcaggcatataatcaattgcggcgtataaccagtatcactcttggcgggtatacaaaagataaagtagaaaaatatcctcctatccgattacgttatttcactttctcagcgcgacaaatgcaggcattggataatggggcggttattcctgctatgatattcgataaacctaagggtgaatttccaagcatttcctgattaatcaatttatgaaataaaaacgggtgtatttctctgttcttatcgctttatcaggaactgcgaatgcggcaacaacttataaggatggcgtcaactggcatgttgctgaagaactgacgtactgggtgaactaaccatgacagggggttaggcttaaaacttcgccttcacaggaactggtcgcttgcaggcatggcttaatgaactggcaggcgcctatcgcagggttgaagtgatgacttacagggagatcatcactgcgttgccggcattgcccgctgacggggaatggtggcgacgcagtctgcggggtgtggggcggcaaagagccccgtcaacgctttatctccatatcgcacatatcttcaagaggctgccagtttgtgttcctgacgctaatctggatcccttattttcacttttgagttttgatttgtctgtcgtatccgctgaactgtttttgcatagtcatggcgaaaaccgttttccggaggacttataccatgacgacaacgacggcatcttctgtcgatattccgtcagataatgatttacctttatccgctcacctcactgaacctgccgaaccggctattgatacgtctgatatcactgttacaccagatacttcagcacagtcagctgcataccgactggggggaaagaggagtcgtctgtggcatccttcttcagaccgccgttccctcatatttaaagtgtcatccgttctggtgtactgcttattactgggtgctgtcttattcctctggctgacagtacgtcagcagcagatacagcttaccacccttgatgcggcgttccgcagcggacagctgcagacacttcccgatcgtatgcaggccatagaagacaggcagcaacaattcgttccgaaactgcagggagaaaaatggcagctcaggctgagtgagcaggagctgcggctcaccgcgtttgagcagcaactttcttcgctggttacagaggttaaagagactcaggcggcgactgccagggctgttgcccgagaggatgaaacgggcatgaagctcgacgctgttcataaagcgctgactgagcagacttcgcgtatagataccctcgcgtcttggaaagacacgtggagcaaacgcactgtggcgactgccacgaaggcgaccccgtctcccggaggtggacagtctgccgcaaaaaagtcgtcaaaaccacgggtcattaagccgcctttcacattggtgagtattgaacgcaggggagggcaggcttacgccgttattctgccggcggggaacagtggctggacacagctgcgcatggtaagcccaggagagagtctgtcaggctgggtgctggtgaacatcagcggtaaccaggctgagtttcaggttaacgggcaggtacaacgtttaacgctctgaatcagggagaaatattggatgaaaccgatgaaatcaacgttaaattgcctccggcagtggactgcgtcagtcatgctggctgttatcgtaagtctgcctgctcttgcatcagtgagtacgggtcgcagtgtaagcgcaccccagcagcaaaatacgactacagaaggaaggacgcaaacgtcaggaacggcatggggactcagcgaaaaagaatggcagcagtatcaacaggtacttaaaggtcccagagcatttcagtcacctggcattgacccgttgatggcactggggctggaggccggttcggcaagcgaacgccggcgttttgctgaaatgtgggtgaaggaagagtatgcccggggtgaaaaggagctggcctttcagcgggaagtggatgctgcctggaaacgcctttatcccaatactctctccgtaaacatgggcaatgccagcggtattgcccatgatacacagggaagactggcgttatttgtgaagcgcaactgtgtaccgtgcgatgccagagtaagtgcggttctggcagataaccgtccggttgatatttacctggtcgacagtggcggcagtgatgacaccattcgccagtgggcgcttgcacatcatattccggtcgataaagttcgtagccggcagataaccctcaaccacgataacggcaactggctgaagtatggtcagggatatatgccggttatgcttcagcagggagtctccggatggcaaatcgcagcattctgacagcagccagatacagcgtccctgttctgatccttcttatcgggggtgttggtagtgcagctgcggtagaaaagggacgcggtctgcaaacaattcccccgggttaccaccttgtggcaactgaagtcggcgtacccgctgaagccctgtattcagtttctcttgcagaaacatcccgaaaactaccacatggagagcgaccgtggccgtggacactcaatgttgccgggaaagggtatcggtataactcccgccaggaagcgtatgacgcaatgttgtcgttcatgcgtcgctatccgttaaagcggattgatgttgggatcgcgcaggttaacctgggctggaatggaacttatttcagcagttactacgaagcgctggatccatataccaaccttcgggttgccgcccgtattcttaaatcctgttatgacaacaatccgggaagctggatacaggccgcggggtgttatcaccatcctgcaggtggaaaaccagcacgaatctataagtccatcgtgaaacgcaagctggcaacactggatttaaacgcgccagtaacgtactccgaacttcagatcgcacagatatcgccatcacagcgccatttctcacactacaaccgtgaattgcaatgggttgaacccagggagtcccgtcagtgaaactttattctgtctgtttttttttcaggacattaatggtcagtattttgctgacaacatcatcgatggcagcactcaatgtgattgctgatcttggcggagaaccaacagcgccgctttttgatgccatcaataataagaacaacgagttcactccgccgaggtcactgaacgccacgggcgcgtctgtaaccgcagcccctgcggatgtaagtgatatgctgcccgtaaccacaccggaaatgcgtgcagggaaagtggaagcccgtgagttaaatctgaacgggatgacaccggtctttcttgttggggatgattcgctttcacgcgagtggttgacgatgcggcgtgatgagcttaagcgacttcatgctacaggtctggtggtgaatgtcagcgataaggacgcgttgtcggaacttcagcaaatcatacctgatgtcattctgctaccggcatcggcaagcgaaatagcgcgtcgtttgcatctcaaccactacccggtgttgattaccgccaccggtctggcccagtagggtgctctcatgatcactgccattcttcttttacttttctgtcttctcattcctgccatatggcgtaagaaaatgccgtccgcacgcgaccgccggcaccggcgctaccgacagaacgcggagcgtgtgctgtgccgtctgacagcgcttgattcagacggggcccgtctaaagtatcttcgaaaaattaacccgtatgtgtttgaagagctgctgttgttggcgtttgagaggcagggactcctggttgtgagaaaccagacctacagtagcgatggcggacttgacgggcaggtttttattgacggaaagcgctggttaattcaggcaaaacgctacagacggactatttctccgcagcatatacgtgagttcggagagctgattacccgggagcaatgttgtggattttttattcatacagggcggacgggtagtaagagcgttaattacctgcagtgctggcgaacaatacaactgatcagcgggcagcgactacttgatttgctggcggggcgccagtgctggtaccaccggccagtaacaaagtcagttgccgggcagccggttgttacataacagtgtgaaaggaggagctatgagtaaccgttatgtcatggaggcgttattgaggccagcagtagaactctattcagctgcggctggcggggctgccacttttgttctggttgtcgcaccatggtcgatggcgttagcaccacaggtcagttatgtgactgcagccggttttgccattttcacaacaatcagaactcgtcagggtttgcgcatcttgcgctatcgacgcaatatccgtcggttaccccggtatcagatgtccagtgaatccataccggtaagccgacattttttgtttctggggaaaggctttatgtgggagcaaaagcatacccaacgtttgcttgagacgaaacggccggaagttgctccctttctgaaaccgtcagttttttactccctggctcgtcagtttgaacgacggtatgagtatacattccctgggttatgtagcctgacaagacgagattcattttttaatccggtacgcccattaccccctgttggtggtaattcggcgatacatggtgtcgagatggaggaagataatgttttgatgagtcttaccgagcgcgttggacatcttcttgtattaggaacgacacgagttggtaagatccgtctggcagaactgttaattacgcaggatattcgcagaggaaatgtcactatcgtttttgaccccaaaggtgatgctgatctgttgaaacgaatgtgggctgagacgaggcgagctgggcgtagcgacgagttttatatctttcatcttggctggccagatatcagtgcccgttataatgcagtcggccgttttggacgcgtatctgaagtggcctcacgtgttgccgggcagcttgggggagaaggaaataacgctgcgtttaaagagtttgcatggcgctttgtcaatatcatcgctcgtgctcttgtcgttcttggtttgcgacctgattattcgcttatcctccggtacgtaacaaatattgcagagctttatgagacctatgccgagaagttactgactcaacaggctccggagttgtggctgatggttcaaaaccagatggggatcctgactgaggatgatttaccacgtacgatgcagggacaggttaatgctattcgggttatggccattgaagtggcattatccagtgagcagggcaaaaaaatatacgatcccgtactggatgggttgcgtagcgctgtacgttatgatcgaacatatttcgataaaatagtcgcttcattgttacctcttctggaaaaactgaccacaggcaaaactgcggcactattatctcctgactacagtgatatgaatgatccgcgcccattaatagactggcaggaaattatacggaaaggcggtgttgtttacgtcggtcttgatgctctttcagattctgaagttgcttctgcggtaggtaacagtatgtttgtcgatctggtttcaacagctggatatatttataagttcggactgtctgatgatatgcccgaagggagtagccagcggttacccatcagtcttcactgtgatgaattcaatgagttaatgggagaagaattcattccgatgataaataaaggcggtggggcaggtattgaagttacagcctatacccagacctggtcagatattgaggccaaaattggtaatgcagctaaagctgcccaggtcacaggcaatttcaataatatgattatgcttcgtgtgagagagaaaacgacagctgagttgctgacaacgcaattacctgaagttgaaatttatacaaaaacactggtttccggtgtgacagatatatccaatccggatcaggggagtgatttcacatccaacgttcaggacagagtaagcagtacacgtgttcctcttttatctcctgcagaagtaatgaatttacctaaagggcaggcttttgcactgctggaaggagggcgattatggaagattcgtatgccgctgccggcatccgttgatgatgaaatgatgccggtaaacctgcagagtattgtcactacaatgcgtaaacactaccgaacgggagacacctggtggtcagggagtgtgctccccggagataatctggtggatgcgctatgagtacagaaaaaaacagctctcaaagttctccaccaccgcgcaagccaccaggtttgctgacccttgttttgtggatctggccagtcaggcttttggcttttctgctggtatcctggatggctggtgtttttattgaatgggcaggaatgttttttttctggtcagatcagggagctttgcattcccagtccgttatgaataaagaacttggctatttatcagcagattttactcaaagccttattttttcttcaccatcagtaactacgatgggctggatttcgtcagcttaccaatgggcatttgtggacagtggattactcacctggattcagaaagaacaaagggagacattaagcagttctgactctgttgttttttttctgggacaagtgcaggcctggttattatcagtgttaagcgattatctgcttgcgctggtttatgtcaccgtcgtttttgccgtcagggtattaattcttgttttatccatcccgttatttgttctggttatcatcgtcgctgttatagacgggttgtgtcgtcgtgacctgagacgttacggggcgggttatgagtcgagttttctgtatcaccatgccaaacggtttgttaaaccggctgtttatctcccttgcttactttacttgtcatggcctgcgtcgatttatccaaatctgttacttctgcccggggcattgttactgggactggcggttactgtagtgacatctacattcaaaaaatatctgtgaccggccagggtcaaccgctgacttattgtcttctctggggggctggcaccagccccccgggaggatataaatttcaaaaaagcataaagagtttcctgctgcatctcctccctgatttcgccactctgttgtgacagacgtactccatgaaacagaggtggtaatgcaaagatgtcaattatcttccagacctttaagggtttttactcgtcctcagtttgttctctctgccagagatggtcagtgcagctgaaaaggatgaactggccctcgctctcaggcagctggaccaggtccagtctgcgcttgaacgcgcgaaaattgtagcggtacaggacaattctgacgggcgtttcttcttcgactatgagcgggcaacacgtgatttgaaaaccatgaagcaggggattgaaacttatctggagccttcccgggcacagccaagagacaaaggttctcttgttggacaatacaggaaggagcagccctgatggctatgaattctgaacaggcaaacgcttttaaagcagggtcaggtatcgaccctacggtacttaataagtttgttctgggttttgttctgagcgttctttttttgtggtttgcctggtcggtattagttgtgtttcgtggatggcgggcaggaaaagtcactgagcaaaatgctctccatttttttatcagtacggccattttggttgtgttttcagtatggatgttcgccagctgaataatttgtttggttaaaaggaaaacatgatgctttcaaagagtaaacatgggttaagagtaccacttccctgtcttttgattctgctgttactggtggcgagcttctcctctcatgcaggattacctacggtcaatattcccggtgggggcggtgggggtgacatgatgcaaacgatcaagcttctgttttctgggtttctcgtcctgatggggctaatcatttgtgctgtcggattttatatggtttccggcgctattctggcgacattctcagaaatacgctccggtaaagcagaatggggtaaatttgttgcgattgtcgttgtcggtatagccattctcgttgtcattgtctggttgtgtactgaagccgcgaagattttgaattgaggtggcctcatgaaaacaatcgagtttttaccggacaggctgaatgccgaaacggtagttttcagagggtttacaacaccagaactgggctatgcagcacttattggtgccgtgtcaggcttaattttgtctctgataatgatgcttgtaacggggatcggctggccaattattccaacctgtactcttatcactccactgatatttatttttatcggtggacgctttctggttcgttttaaacgtaataaacccaatttttacctctacctccggattcaaaaaatactgagccatattggtatcgggagcaaagttctggtccgtcatgatcgacgctggtcattacgcaggagtaagcctgtacgcaaggggggaatatgagccgatttcgccatgctctgaaggatcgcgatcagcatattttgaccctgagattagcgtgtggagttctgcttctcttattgattctggttattacaggatggatgcgggcgcccagtgacctgacaatacataacccgccagatttacgcagcgggagtacgcgtaaatggtgggaggtccctccgagtacggtctacagctttgccttttatatttttcagcaaattaatgcctggccgaaggacggagaaaaagactatccgatgaaaattgcccagttgagtccttatcttacgccatcatgccaggattttttgaataaggatgctgagctacggagtcaaaaaggtgagttgcttgatcgcgttcgcgtcgtttatgagatccccaaacgtggttacaaacctgaaagtgtcatcattgagagcgatgacagttgggaggtcagtctggatttggtagtcgatgaatactatcacacagaacctgtaaaacgggcactggccagataccccctgcatattgtccgctgggaaggtgatccggagcgcaatgcttttggtctggcgcttgattgctataaaggcgtcccacaacgacttgaagctgcagtggtccctgagccagagaaaaaggggatgttttaatggcgatgtttaaagtccttaattttaagtgtaaatggtggccgataattctccttttatggttttcatcagcacaggctgtggagctgatgaaatgggaacggatccctctgcttattccactttctgttaaccatgagcgaattgtctttgtcgaccgcaacgttcgtgtaggttttccggcaatgctcaaaggtaaactgagggttcaaagcagcggtggtacggtttatttacaggccagcgaaccttttgaacagacctgacttcaactgcaggatgttgaatcgggcgagattatattactggatattgctgccaaaaatgacaataaggcgcttgagcctgttcgcctggtttattcgggagaagtgttatcggtgagcgaaaaaggaatggaaacgggttcttcgttgccagtcgcctctttggatacagaagataaaaatcagactgtcagaaaaacgccggtgtacagtgctccattgccagtggtgttgactcgttatgctgcacaaagtctgtatgcccctctacgcactgttgaagctgtacccggaattcatccggtaaatttacgccttccctcgagactcacaactttatatccgtctgagaatgtagttgtttcgccaataggggcatggggtattcaggaactgaatgttgttgcactgaaaatccggaatcgttcttcctccaaagtgatacttgatgcccggactttatcaggatcgtttgtcagtgcgactttccagcatcgttggcttggggcggctggtacgcctgaagatacaacaactctttatcttgtgatcagagggcgccctgagaatgcctttattgctgaacctgcagtattgccggcagtaaaaaaaggggaacagcatgcaaattaaagccaatggcctgatgaaggttttacttccagtattgatcgtggtggtttgttttattggcgttaaagcctgtggtttaaaagatactactgaacctgaacccgctaaaaccactaatgcattgactgagttgagccaggatgatttgaaagcactgggtattgagggggatacgtcagcagacacgctacgtacacttattggagcgttgcgtgatgtccgggcccgccaggctgtgctggatgagcaaaataaggcactcatttctgaaaataataagctcaagggtgagaattcatcggtaggactccagatatcaaatgctgtaaatgccgcaaaacaggaaacgaacgaggctcttgaaaaacagaaaacgttcctactggagaagctcaatgacctgaccggaacactgaaatcccagggacaaaacactgacatggtgtcgacaggttcgtcttcaggaaccgatttcccggttggccttggactggatccagagaatgcatcctctgcaactcagggggaggtgatctggatatctcctcaggatgctaaaaagacagagggtcaaagccagagtgataatgataaattcacctttcccacctcttttctggatgataaccccgtcagtcgtcagcgagctgagtacgatcgcgttgttaaaaacaagcaggaactggacggaaacggtgcagagtccgatacacggcctgtttatacgttgcctgagaactcaatcctggtaggcagtaaggcgatgacggcattaattggtcgtataccaattaatgacaaagtcaccgatccttatccatttaaagtcctgatcggtaaggataacctaactgcaaacggtatcgaattgcccgatgttgagggggctattgtttccgggactgctacaggggatatggtgctttcgtgtgtcagaggaacgatacattcgatcacgtttgttttttccgatggacgtataagaacacttcccagacccgtagcaaacactcagggcaacaataatgacaacgccggagacaggggcagcattggctggatatcagataacaacggaattccctgtatcagtggtgagcgcaaatctaatgcttcaacttatctgccaacggttgcgttactggggatgggaagctccgcaggtgatgcgttaacacaaaatcaatataccactcagaacaatgtgaatggtggggtgacatcagccttaaccggcaatgcggggcaggcggtactggggcagacgctgggagggggatttaaagaagttaccgactgggttaaacaacgttacggacagacgtttgatgtggtgtatgtcccacctggtgcaaatgtcgctattcatattactcgtcaactggccgttgattatgaagaccatggtcgtaaggttcgatatgacttcagcttgcccggaacaggaggccattatggtcttgactgataatcagaaaatcacttcacgtacagtgaaaataactcccgttttattttttatagcgggcatgttcagtgtcgcgcttggtggatgctcatccagcaaagatgaattattgcctccgggagacagttcaatgatggagctctggcaggggaatgctccgacatctcacgccgttgtcaaagggcgggagactctcaggcggagtctttcgtctcaggaaacactggcttcagggcgtattgatgaaagctacagccgtactcaggagaatgagctgagccagattttcccccggttacctaatccggatatggtgatgtacatatttccgcacttggctaatggaaatacgcctgttcctggctacagcactgtctttcctttttatgctcaaacccagtatgcgcttcctggtgaacggacggaggcactgtgatggtcagtttttctttgtttaacaaaaacaggctgaagtcatcttctccccgggagcctgacgagttaccggaaagtgactttgctgttcatggccgtgacccactgaaacgcccgggcatgatgagtcacgctgatgaatcccgtttatacgaaacccgtccgtccattattgattttttgccctgggccgagtacctgagtcgcgagcaatgtctgctgcttgacgatggccagtctgtcggtgcggtatacagtatatcgccagtggcatcagaggggcgcacagctgcccgtctggaagaaataagggattcggttgaagatgcacttcaggacagccttgaagagtttgattctaacccatgggtagtacagttttttgtcaggatgaaactgacttcagtgcctatatgaatcggttagccagttacatcaaaccgcatgctcagaggacggcatttacgaaggcctggctggctgaaacagaacagcatctgcgaaatatcacccggccggaaggtttgttcactgattcacttgtcaccggggttccctggcggggacaaaatcgttccgtcaggatggtggtatatcgatacctgccagcgaattacaaagatgattcgccggttgccgctctcaaccaggtttgtgagcgcctgacttcagccttatctgcagccggcgttctgagtgtccgacagaatggcgagcagatacatcgatggttgttacgtcacttcaatcctgagcccgactggatagacaaagatacgctttaccgggaggctcgttattatgatgatgcacctgattcattgcctcttggcaatgatttcactgagacgttgtggtttaaccctccacgttctgatacccgaaatggtgtgtggtggtttgataatgtggcgcatcgtgccgttcctgttgaaacattacgtcgccctccgggacccggtcatctgacgggggaggttaagcgtggcgacaatattaatactctgatggatttattgcctgagggcacaatggtatcgctcactattgtggcgcaggctcaggacacgctggaagccgggtttgacacgctgggtaaaaatgcaatagggcagaacacggaatccaggcggacccgtagtgatgtggagcaggtgaagagtttgctgggcatgcgtcacaaactttatcgtgcatcgataacttttttgatgcgtgcacctgatgtcagtgagctgaataaaaaaatacagcaacttaccgctacattgctgactgcggggcttcagcccacgaaacctgaatacgaagtggcgcccctgaatgactatttgcgagcgcttcctatgtgttttaacccgcaactggataaaaaaaactggtatacccgcctgacctgggttcagcatctggctggattgcttcccgtgaccggtcgcagccagggaaccggacaccccgggtttagtttttttaaccgtggcggagaactgttgtcttttgatcccttaaatagtctggacagaacgcagaatgctcacctgttgctttttggtccgaccggggcgggtaaatcagccaccttatgtagtgcgttatcacagttaatggccgttcatcgtccacgcctctttattgccgaagccggcaacagttttggtttgctggcggagtatttccgggggctgggactgagcgtaaatgtactgagtatcaaacctggctgcggtatttctttaccgatgtttgctgatgctcattccttaatgcgagtagatccaaagaaaaacgtggtttctgaggaagctctacctgagctggagccagccaataccgacagcgcagaagatgaaagtgaagagcgtgacattcttggcgaaatggaaattgcagcccggatgatgatcaccggtggcgagaagcgggaggaggaacgtcttacccgggctgaccgcggtcttattcgtgaagctatcatgatggcggcggagaaaacatatcaggacggacatcagatgctggctgaggatttacaggctgccctgtggaatatctcacgtgataattccattggtgcaaatggcgagcttatgcggaatcagtcccgtcgcgatcgtgctgctgagatggcagaagccatggccatgttcactcagggatttgagggagagttattcaaccgtccgggaacaccatggccagaggctgatgtcacactgatcgatttaggtcatctggcacgtgaaggctatggtgcacaaatggcgctggcgatggtctctttaattaacacgattaacaatatcgccgaacgtgaccagggaacagcccgggatattgtggccgtatttgatgaagcccatatttccacgacgaatcctttgttgtcgccctatatgaccaaggttgtgaaaatgtggcgaaaactgggggcatggctgtggctggcgacacagaacctcgaggattttcctgatattgcgcagaaaatgctgaacatggctgaatggtggttgtgcctggttatgcctcccgatgaggtggagcagattgcccgtttcaaaaccctcagcgaggagcaaaaagttattttgcgatcagccagtaagctcaaaaactgttataccgagggcgtcgttttatcaaagcaggttgaggcactgttccgggttgtgcctcccagtctgtatctcgtcctggggatgactgaaaaagaggaaaaagcggaacgtcagcggctgatgcgagagtatcagtgcagtgagcttgaggcagcgatccgggtggcccgcaggctggatgaggcacggggtttttgtccacaaaaagcggcctgaaaaaacaattcctgagccacgggcaatggccaagccctgtgaccagttttaccaatatcagaggagtcattgttatgtcatcagagtggttgtccggggaggctggacgtgaaggatctcttttgctcaatgatggtatttcaatggggggattatgagcctgttaaagcatgagcaatggttaattctcggtgaagatgaatcgcatcgtattccgcctgatgcgctgctgggtttgcctccgcagggtaaagcgtggatccgcaaggaacatgatgaggatatgagtcgtctgacttctcatattcagggagctcttggcaatacttatcgtggggtttgtcatccacagcgtatcgggcatcgtgcctgcctggcaatccatcttgagaatttacgcggaaaaaagctggatatattaattacggtaagcggaaagacagcattacctgcggaggaaagttacgttaatccccgatggtacatcgatgttgccgatgccgcagatgccctttatctggcgctgtggcttatcaggtagacaggtacactcgccggcgtaaaagccggcgtttcatattccgcttccacatattctgaagcggggaattattaaaaagcaaaacagagtttattactgcattacctctgcgtttttcgcacgctatccggatagttatcgtcaggagcgtggcatgaaacgaatcctctcttcgctgatattaatcagctccttttctgcaagtgcgcaaatcgttgtttacaccgaccaggggcatcctccggtcggtgtaacaccggctatccgggttgtttatctcgatgccagcgaacgctggctgcagcaacaatttggagagctttcttctgatcctgaacaggctgtcagacaggctcattctctgctgaattctcctgactggaagagacggcaaaaagcgcttatcgaacattacaggggaatgattgaagcatggcagcttggtttactgaaatatccggcggtggtttttgacaaccgtgacgtggtttacgggactgttgatatatcccgggcagtggcgctgcgcaggggagagaatcaatgaaatctcttcgtctgaagcgagcgttactgtcagtcatgcttatcaccggcggcatggaggttcaggctgcgttgaacactgcctcgattgtggccagcagtatttctccgtcgtgtatcagctggagaatcagcggtatctgctactggctgatgtgtacccctttcggttgtacagtaaaaacctcgataaaagtgcatcactttattccggaagctgttgtttcgacttatcaggcgtctggtggaaatccgtggaccgaaatgtcattagtgagtcagacggccggaggggtagagaatgctgtaacgggggcgttatccgggcttgctgccggtggcggaaaccaggaacagaaattcccgggtacccgtaagagtaatgtgcgatttaaatatgcagatgccattggccatccttcaacatcgattattggcggccaaatccccggttactcatgcaacagcgccgccacaccactggtaccctattttcttagcacgcttgatacgcttgcctggcgtactggtgttcctgaatcggtttatcctgaggcactcattcctggcagacgcgaaatcggctccacatcggcacaaaatatatggggaaatctctatccccgaagcggctttgttactcagcaggatgactacaaatccggggcaatcgttgcgcagcgtgtagctgacattatcacccgaactaaccagatccacgtctataagcccctcaccggaaacccgtctgccggttactggcctcccgaacctgttaaagagaataccggcacgcaaaatcataaatggcagcagttatcaccaacgctctctatgtcatgcagcgtattcccggatacaggaaaaattgcggaaaacggtaattacgcctggacactctggcagccatatagctgctgtaaacgccgtgggcaaacatttctctatagcaccgacataaattaagtggagtatcgaaaatgagatctcaatccattttatccgtctgtctcatgctgggtatcgtcagttcgggaccgttaagtgctgcattactggatgcccccacgttgagtggtgatggatatggaaagtcagtaaatggcgcggttagtgacaagctgttttacagcattggtggtggttcggtgatttccactcccgggacgatgtacggaatgaaacgtatcgggctggatgccggactgagcagtgatttgatgtgtggcaactttgatataaagactactgtcggaaaccagcttaatggcgtcacgaatggtttcaaagatttgatgggggatgtgatcaccggtgcgaccggggcggtctcaagtatgccggcgatgatccttcagcgagcaaatccgggtttgtatgaaatgatcaccaatggtgtacttcaggcaggtctggcttttgacaaatcgaaactgaattgtgaaagcatggccaacaagctggctgattacactttgggtgacaagagcagctggacagaatcagctgtgagggaagagtacaaggaggcggtcagtgccagtggcggggatgcgctgcgggcagaagaggccagaaccaaagcttcaggtaaggagggcgctacctgggtaggcgggaagaaagccggagggaaaggccagcctgccattcagccaacgcgtgatctggctaaagcaggatacaacatgatgaataacctgagcgttaccagcaacagcacggtatccgccggtagttgcaaggggtcagcatgccagaaatttaaaaactctgaagaagctgcagcagcggtcgtaaaagttctgggcgatcggagtattcgcacctgtaaagatgccacagaatgcggaagcggcgggattgataatgcccagggcacgacaattgccggtaccggttttgctcccatgcttgaggatacaaccaaagagaatctggaacagctggtaaagcttgtaaatggtactgaggctccgactcaggccaatctggataaaattaaaagtggcagccttaaggtaacgcgtggtgtcatcgatgccctgaaacgcgatcctgatgccggtgcgttggttcagagactggctggcgaactggccatgtccgacacgattgaaaccggtctggcgatgcgtcgcatgttaacgactggccagtctgaacccaatgcagctgatcagcctcaggcaatggctgaagccgatcgccgtattgaagctctcgatcgtgagcttaactctcttaagctggagatggaactgcgtcgggaagtggcaaaaaataccgcgctggttgtggttgcgcgcgaagaaaatcgttcggtcaccaatcctcaaaaagaatcgcagactaatgctgatacccggctgagtgagcttgaaacgcgtaaatcaggggacagccaatgacactgaggatcttaatcaaaacaacttcatttctgagatttattctgacgcttgtgttcatgctggttatgcttacgtgcctgtcccttgcactggctgatttagggtttcgttatcagtctgaaatagcccagttccggatctggatgaaggaaacctggttgttgtggcttctgtggcggctgatgctttacagcgtgactggttgggggatatggcgttgttatcactcccatggctcttctcaggctctgcgtcagagtcttctgcggattgctgtcgtttctgttggtttcgtcgcgatttgcgaatattcagtgttgaggtagaagatgacgacatcgagctatcttgagtacatcctgacgattctgggctgggttgttaataacggtttgtgggatgttctgacaggcacgggactttttgcattaccactgggctttaaaatcattggtatctggatcaaaacacgggaagaaggggatgatgagggtaataaaggtatcctgtcggcccgacggatggaacatgctatttacggggcatttatcgttattatcgcctgctgtgtccccactcagacagtgtcactgacaacgctgacgtttgatacaacccgtgcgaaacagtgtggtttctggacaccggtcaagcccggggattcaggctacggtagtgtggtttcaacaatgagtggtatgactgcatctgcgccggtgtggtgggcatttatgcatatgatttccaaaggcgtcactcaggcggctgtggcaagtttaccctgccggccagacctgcggcaggtgcgttttgacgttcagcatacgcagatcaccaatcctgctctggctcaggaattgcaggattttaccagtgactgttatgcacaggcttttgcgttatggaaacggcaggatgcggggagaactacggatattgatgtactcagggatattgaatggctggggtcgaaaatatttttgaaggatttttacccgcagctgcattcgaagttgcccaggtcagcgttcccctggtcgcaaagccgcgatgacgggtacgcaaataccgggcagggggggtatccaacgtgtagcgagtggtggtctcagaacaagacaggcctgaaatcccgtgtgctggatacggtaaataccaccacgatgacacgcatggcggcagcatttaagggaatggtcagcaaagaggaatacacggaagcgctaattcgacgtctggtcagtccgacaagtctctctgtgtcacagaatggacgtacttatgcaggttatggcggtaatgccgattttacgttagataatgctgtaaatcgcatggcttcagtgctggggaccagtgtgggtgcccttggggcgttccccgcatttgatgccatgcgccaggcgttaccgatggttcaggcacttttattgatggccatgtatgtactaatccccctggtgctggtattcgggacgtatgaatataagacagtagtcactctcacttttgtgacgtttgggatgcattttcttacgttctggtgggagctggcgcgctggctggatagctggcttctggagatcatgtatggttcggacagccatagccgatggaatgtggccggttttcagaatagcgcagatgacctgatcatgaactttgttatggggacgatgttcctggtgttgccggcagtgtggatgggggcgctttcctgggctggggttagaattggcggcattgttgacactaacttaaataagggagtgcagccagctggacagcatggtggcaaagttggtgataaaattggctcgggaatagctaaataagaaatcgtgaaagcactgtaaatattacagtgctttcataggtcatcctcattatctatcgcatatattaagtggcatactggaaactctggtttccattctttatattcccgttttcggggcacagatcaaatataattaagaaagcacattttaatattgtcatttcactaacaactgaactaatgcttagcagggtaattattcaacatagcagggagatggttttcagacactcatgtcagataacgtcattatgcaacgtaatcaaatacagaagatcagaaccggggaggatgtgctgtctgcggttacaggccgtgtggagtggatatttgataccttttctcaggtttgtctgtctttttcaggtggaaaagactccaccgttctgtttcatatcgccgccacaatagcccgcaggaaacaccggcgtttctctgtcctttttattgactgggaagcccagtatcagtgcacgattgagcatgttcagaaaatgaaggatctctacagtgatgtgacggagacgtttttctgggtggctctcccgctgacgacggtaaatggtgtttcacagtttcagccagaatgggtctgctgggagcccgatgtggagtgggtgcgtcagccgccgacagatgccattactgatacgacgtattttcctttttaccgttacgccatgacatttgaagagtttgtcccggcattttcgacttggttcacgggcaatcagtgtggagtggccatactgactggcgttcgtgcagatgagtcccttaacaggtttataggccttaccagccagcgaaagcttcgttatgccgatgacaaaccctggaccaccgcctctcctgaggggttttattacacgatgtgtcctctgtatgactggaaagcccgggacatctggatttaccatgcccgtacgggcgccatttacaacccgctgtatgacctgatgtacagagtcggcgtccccctgcggaatatgcgggtctgtgaaccttttggccccgaacagcgccgcggtctgtggctttatcatgtactggagcctgagacctgggcgcgaatgtgtgcccgcgtctccggagcggccagcggggccatttatgctaatgaaagtggcgcttattttgccctgcgcaaacgcatctccagaccagcacatcatacctggcgcagctatgccatgtttcttcttgatgtcatgccacaaaaaacagccgagcattaccggaacaagatagcggtatacctgcgctggtatcagacgcacggttatccggaagatattccggatgaacaggagaatgacctgggcagcagggatattccctcctggcgtaggatatgcaagacactgattaaaaatgacttctggtgccggaccttatctttcagtcctaataagccccggcattacgaacgttacctggagcgtatgaaacaaaggaggaaggaatgggggatattgtaaccagggaacaggtggccagtctcattacccggtatttcagtcagcagctttcagatgacgaaaaagtggcagccctcaatcattttcgcctgacacttcatgagctcagcccctttgcccgggagcctgtggacctggtgctgtgggtgaaagccagcgaagtggtggccaacgattacaaccccaatgttatggctgccggagagaaaaaattgctgcagcactcactgcaggaggacggctttacccagcccgtcgttgtatctgaagagaaagggcagtacctggtcgtggatggttttcaccggcagttgctgggcagacgcgagtcaggagcaggaaaacgcctgaaaggctggttgcccgtcacctgtatcaatcccgaacgaaaggggaaggctgaacgaattgcctcgacgatcaggcataaccgcgcccgagggaagcatcagatagcgtcgatgtcagatattgtcagagaccttgcccgtctcggatgggcagatgaacgtattggcaaggagctgggaatggacagggatgaagttcttcgtctgaagcagataagtggactgacagaattatttgaagaagaggacttcagtccggcctggacggttcgctaaagtggacagcatcttatcgcaaataaaactatttcggccggtgacctgaattattatttaatgattaccaataaagatttccgtataagaacagggggcattttgccccctgttctctcggttataaaagcaggttaaaagttattaagcctgtatcaacttaattctgcgtctggcatagaatgtttcctccgttatctcaagacaatattaagtctgccttaactttctcgatttaagcatttttgccgtaacgccagttatctgcccggagtctattcgcctcctgatatctgccgaactcagcataagttgtattttcattatggacagcaggcttacctggaaagagcgggttaacctgattcggacacatatctgatattgcctcgttatactggtcagacagcgctcctgaatacggaaatcaagttgacctgatagttttgcattgttttgcttcagaacagcagtgtcataggcaaaatgcctgattgtggattcatcgtttgtcatcagccggtgatgaagttcctgatttattttgcttacaggaaggcgggaatacagcgctatattccaggtgtaatcgcagtgagtacatttatagatactccatacgtccagtattttcttttgtgaattaatcctgaatgcacctgacggcgtgaagtctctttttacattgcatgacggacagcgttttgcgatgtgctgataccccacaggagtgacagtccatgttactttcataattaaccttttttacccatacaaaaccggatctgtatggaacggaccatagagatttgtgtgtgaaaaataatcagaagatatttttcagtgggttaaaaaaagatttccaacactaccatcctgtcaacgactgaagcgatacgatcagactatcaaagaagtcttcttcagatatatgcgttaaattaatattggcgtcgtaacccgcaggcttgcctttgatgaagcggaatatgatatttagccttttaagcaggggggagttgtattgatcaacgtggcatcaatgatctactatacgaacgttgtaatggtgcattagctgcacccaccaatgccccggtgatctgagaggggcgccttcgggtgattgcataccaatgtcaccgtagcctgagaggtggcgccttcgggtggtacagccctttaatctttggaaacggctgtcgtgtacttctgcgacgaagatatttttactacatgtaagtaccgtttttcggtatcagatttttgacctgtcttcacgaacagtggacgatcgcttcttctttctacggttttataccgtatcttttagtactcacttcttaagcctccgtgctcagacaacctttgcatgtacgggtatgccagccatttggcgcgacgaacgtcgcaacatttggggcatcttccggacgatgcattggacagtttgagtatacgcggcgtcacttgcgttcgagtaaaacgagaaccaagtgacgccgcaaggcgtaaaacatcttcagcacgtatttcctgatcttccgaacagtttaaaaagtgcattcgttcgtgaaaccagtttgaggaatgcgctgaaaaaacgttttctacaacgcccgtcgcgtccgttttccacggacggccgctcagggcccgtgtttaacccgttgttaaggtttcatctgtgaagcttaacgtaatgattaatggaggttttatcgtcatgatattgaggcgtcagtaattactgacggggagttaaattcgccgtactgcgtactggttgaactcctgcaaaaactcaacatagcgctaccctgctacacaatatcagacgagtcaggaagacgaacgcaccgacacgcagggaacgtctgtgatgacgaaaaactaatatttccagctggttatgacagttcatttcatgagtgagaactatcgacaagtgttctgactgatgggatgcgctgagggattagtgtgtcttttttcaccagtgtcatacagggggcaatatggcagggaaaacagctcgttcaaaagtggagaaattccgtcgcgattttgtgaccttagcccgggatgccggcagggcatacgcgacggctgcagacagcatgcgtatcgcgaaatactttctgaactaccttcgtgataacggtattaagctacgtcataccgacagtattaaaacacgtcatgtcaccggatatctccagttcagaaaatcacaggggatttccgtgcggacaattcagaatgagcgggctgctattcgtggcgttttgaataaggcgggacgttataagctggcagacccgaataatccgctcctgagtaataaggctcttggattagaaaaaagtagcaggtcgggaacaaaattaccgttaagcccggaagaatttcaaaaggcatttaaggaggttgagaaaagcaaccggggggttgcagcaacaatgttactttcttatacgctgggtttaagaactaaagaggcagtggagtcctgtaaatccgtgatgacatggaaacgtgctcttgagtcaggggaacattcagttcgtgtaatttttggtacgaaaggaggaagaggacgaaatacgctgattgttgataaggacgctttaaggcatgcaataaattatgctgaaaaagtaatgaaggaaaataacggtaaattgattgatcgtcctgatattcgtaaggcgattgatacctaccgttatcatgtcagacgtgcgggtctgacaggtgaaaaagcacctcacagtatgcgttatcatttttcacaggaagctcgggaatattatgagaagaatggtttttctggtaaggaaatatatgctcaggtgtcaatggatttaggtcatggagacggaagagggagatatgtaaaacaggtttatttcagagatggtactgaagatgagtaactcatgttcagtcgatgaggcagggaatgttttttagggatttgctgattctaatgagggtttacattaattcataaaagcagatacacagaaagtgattatttgcgtcagtatgaaagattgactttcagtggagtgttttttagtacctgaaatttccagctttatctcgtgcagacttctcatgtacctgtctttagcacgttaaaaaacttcagttacggtcttgaattttcattctcgctctggttaatatgatagcgcttaaaacgttgccttaggcaaccaccaatgttccagtgatctgagaggaacgcctttgggtgatcacataaccaatgttccggcaatctgagaggagtgccttcgggtgattgcacaccaatgtcaccgtagcctgagaggtgacgccttcgggtggtacagccctttaatctttggaaatggctgtcgcattttttgcgatgaagatatcctcaacattcacacttcgatactcgtctttcagcatttccggtgggaaatcttcccactgtggcaggttttataccggtattccgggtacagactgttgatcattttggtccagtgtcttctttgaaggagcgctcgttcgtatcgctcgctttgagacgtttaaaccacaaatcttacatcctgcccatcggggaaagcctccccgatacggtgatggttttctccgttttacttctggagaaaactatgaacatctttctgacttctctggtcagtattctgcgtaaggcacttccacgtatacgtcacggcaaaagtgaatggatcgccaatcacaccggttatctgcgttttcaggcagaggtctggctggatgataacgaccattttcacgcagtcgtcaacaaacgttccggctggatgaatccacgctatgaacaggtggtggattgtggcaagtttgattcatttcactgtgccatgaataccgcgtactcccaggcacttgaacttgcacatcttcgctatgcctgggaactgaccgattagaaaacgaatttccactgcattaacgttaccacccaacaggggatttttccccgtagggggtaaatccctctgttgctgttctgacaggaggatttatgaacgtttatcaactgaaaaaccgcactgacgttttgatctggctttcgctgattgagggcgatttgctgagtatccaggcttctctgaacgccggtttatatccgctttatgatgacaggcaggaggaaccggagtttgaatgtgcggtatttaactgtggtatggctttcggagaatttatggaaaggcttgaatcagaagatattgacgttctgacaacagccggacatgaactgactggctcgattgaacatatggggagaatgttgtgtgaacccgtttggacacaggctgttcttctggggcgcaatgaagcccgggcagaccgggctatatgcgctgcagaagcggatggctggctgtatgatcctgcttagcatgagattgtttttaactttttgaggtctgtactacaggcctgtctggggcggctggctgagcgctgccgttgttttgtggtgctccccggaacattaccggctaaccattcctgtttttcgtctgtcagtggcaacccgataagggaacagctggcggttgaaagacggggaatgccatagtatcaacttttttacccttgcggggatgcccgcaagggctcccgcattttacgcaggaggcctgatatgggttgataattctattattcatattttccgtcgttgttgacggggtcgtattgttttgtttcacaccccggggcccagccccgtcaggggcaggttcctttatttctacagggatcctatgtctcacattcaccttccgtcggtttgtgaaaaaaccggcaacacactgactccggagcaggaaaaccgcgtgcgccatctggtgcatgaggagtgttattcccgcgaccgcgcagcactgataaagcttattggcctgatgctcctgctgaagctggcgggaaccctcatgctggcaatgttgttactggtgctgcgtctgttctgagaagaaggagattcacaatgatgttaaccacccgcttgtttgtatttttgttgcaccatctctggcgcgtcatgcgctggaccgggctgacggtgtatcacggtatttcggtgttatatcgtcgaagacaggccagactgcaggcctccgactggcgcccccgaacggtgtataccggtcgctggcagctggccgatgatggtcagttctgcggtcgggccgttgttctccggctcagggatgcgctgaaacccggcgtggagctgctttacttcggtgaagaggctgcggagccgtattacagcgagagacaatttgtagacgacagggaatccgtgatggtggctgagcagatgttgctgcggtttcttggcagccggcaccggcggcagaaccggcgaaatgctccagtgtcagtgctggttactgacgtagtgacaacagccccggttaatgatgaggccgcatgatggatataatggcgctgctgagcagcacgccgccggccgtcgctatcgaggagccggtctgggaacaactggtaaaatacccccaggctccggactgtgaaaacgaacggctgcagcggttgatataccacggttttcaggcactcagtcaggcaccttcggggcagggaatagtggagtttggctatttctgtctcccgcctgatggtgacctccatgccccattgtggcagaacgtatgtattaaacgtgaatattcagacggtcaggtgacactcactttcgatcgttaatcagttttaccacctaccctgacggggaaacccgtgagggggacgccgtcagatctttttactcaaaaggagtctgtatgagcgtaatgaccactaacgaaacccctgcatccacagtagcagaaccggaagtttttcgaagaacccgtaaccgtttcaaccagtggttacaggcggaatttgaccgacattatcacacgatgagggatggcggttatcgcagctttctgaagaagaaccatccgacggagctgctgcgctatgacgaggcatgcgaggccttaaggcgggaagaatttgcccgctttgccgagctgcagacgctggggctgtacctgcatctgcaggtacagcaaaaagaggcgcagttccggcggcggcgtaaccgtctgctgttggggatgaccttaacgggcgtggtgacatcagtgttgttatacggtcactttcatcctgagcagtttttgctgatcggacaggagctggcgacgttgcctggccgtatcctcggatttgttggtcggctggtaccgtaatcacgtacgcatcctgcgttactgaaccttatcccgtagggagagtgactccctgtgggggcgctctccctttttttcaggagagcatatgaacacatcgttacatccggatgatatcagccggtttatctccggccgacttatcagtagcctggctgcaggccaggtaccgtggcggggcacaattcccgggttaccggaacacgcgcttacgggcgtgccgtttaccggtattaacgtattgttattgtggcaggccatgcagcagcgttcgcttcgttcaggaaggtggctgaccggagatgacctccgccaactgggcggtcaggtcagatccggtgaaaagccagtcaccctggtccgctaccggccttcgttatcgcttttcaaggtaattaaccctgaacagtgtgatggtctgccggatacgctgcaaccggggtggccactgcctccacgacctcagccgtcactgaatgtgatccgcgacctgcttcagaacagtggggtttccgtgatccacagggacaacgttttgccggtataccgggcattgcatgaccggattgagcttccacccgtggcatcgtatgtcggagaggagacatactggcaggacatactgaatctgctggttcaggctaccggacatccgcagcgcttacatcgcttcggattaacagtggatacacgtaccgatgaggttcatgaggccctggttgcagaactgggcgccgcatttctctcggctgctctgggattaccgggagcgatgctatccaggctggatgtggcaccctgggtgacatatttacagggggacccgtggcgtctctttcgggctgcggaagcagcgcgaaaggcgatgatgtggctgaaagagcgaagaccctcgatgacgacagtggagatgtggcagaagatggcctcattgattcttgaaacgcattacggtttttctctcgatgacaccacgctgggatgtcgcagtgtggttgagcggcatattgaatgtgggatcactccactgatggcgattaatgcactggcccgcatttaccagtgggaacgctacgaccagcctcagcggtcgctgtttatcaacgaagcaggaccagacagtgaaatactgactttgtctgaaattcgtcccgaactgctgacctgttaccgcgtgcctgtgccatccggtataccggacaggaaagcggaagcggtgcaggtcgaaagtttacctttgctcctggcaccggcggtgtcggaaggtaagagtgcggcgaatgatgacgggcctgatgacccggatggtaatgacaatgttgtggcgctgccctgggctgcccgcaggggaaaggagaacccgcatatacatcgttttgtcagtatctttaacggtattgcacctcatgaaagccgctggcaggtattcagtgatttcgtccatatggcggcctgttcactgtacaacgctgtacatcgggatcctgattttgaagcggactacatgaggcgggtatcccactattcagctgaagatgcaaacaacatggcccgtttactgtcagaagttgttatggggctggaattcagtccaacagatttcctggggcgaatttatatgatatccggactgggaaattttcataacgcacagtatttcacgccttacagcgtttcgtacgcgatggcgcgaatgacactcagtgaccgtatacctgaactttccagcggggaacgagactttattactgtcagcgatcctgccagtggtgccggaagtatggtcgttgcgctggcagaagccatgctggaggcgggatttaatccgcagaaacagatggtagcgtactgtgtcgatattgacccggtggcctcgatgatgtgttacatccagctatccctgatgggtattccggccattgtggctaccggcaacagcctgaccgtggagattaaacgggagatggcaacaccaatgtttgtactgggtcgttggcatcaccggtggcaggcagatcggacgcgtaaagcggcctagttgcgtatttatcttcatcccgacagggttctccctgtggggagaattcctgttctgaacaggagtcacttatgctggccagtttctatattcaacggcagctcagtaaagcactgggcctcagtgtgaacgctgaggaggttttttaccaggtggacgatcgggagtcggattacgtcaataccgatatggtactgaaccgtgaccggttattgtccgtgatgcagtttatgctggatgacgtggcgcttaatccggagctccgggaaagatgccgtcaggcagagcgtattctgacactatggattcgtggtctcgacgcgctggcaacagtgtctgaggatatgtcgatactgccccggacgattacggagtgcagtggacgagttgatcgtctgctgccgggggacccacaggcactgctggcgctgccggatgatgcattcttacgcctgaccgcccagtgtcacctgatgtccggagagcagttcccccgggaacagcttgcagcgacgatgccttactggacgcgttttatggcgtggatagcccgtgaactttatcaggtggaagatcgttgtctggtgcaactcgggcgtctttatcgccggctgcacgtggagcccaggaaaatacggtgctttaacctggctttcggacgtattgagctgcatatgtccggacgggatattgatgaatgtcagtatctctacgcgtatgacgacgcatcgctggaagattatctggaggaaattatggccggtaatctgacgccggttcgctttgaagtgcgggtaatataccgcaacgattcggagctgaacgtcttcaggcgagacgccgacgtgattgatgtggaacatccccatgtcagcgactggcagaatgttgtcagcgaggccctggactggctacgccaggaacggacgtcgctggttgagatacctttaacccggccggcactgaaactggccgcctgattaaccactataccctcaggggattttcccctgagggggaaaatccctttaataaaccagagaggattttcccgtgagcattattgacgaatatatcagccagcatttctcagagcggctgtgtctggacgtaaccgaagaggatattacctggcagcttcgcggcagccgttccgactacgtgaatacccggatacagtttgaccgggaaaaactgatggcggtgatggatgtcatgctgtccggtctggacagtgatgaaaccacgctggcgcgctgccggcaggtactgacgctgtggatagccggactggatatgctgtcgaaggaggcagaacaacctgactggcttccccgggttcaccctcacagcagtggtcagtgcgacctgctgctgaagggaaaccctgcggcgctgacggaggcggacgaagaaacgtacctgcgggtgaccggccagcaggatttaccggcacaccggcgtattccacaggtgatattcagcaaaacggtacgatactggcaccgttttgagagctggctggcgcagcagttgcaggacattactcagcattgctatcagaaactgaaatgctttgtggcgaactgcacgacagagcccaggcagctgcgcgaattccgcggggagtacggttcactgcgtttatttgtggggccgcaggatatcgatgagatagacattctggagttcaatccggaatacatcgtgtcctgggtcgacaaagtcgcggacgggctttttactccagtctgctttgtggtgaatgtttactataaaaacggcattttgctggagtcgttcacctgggacagtgaggtggataacatcaacaggatgaccagcagcgattatggtgaggcgatgagccaggccatcagctgggtacgtgagcagtttgagcagccggtgattgatcaaccggtaccacagcagccacgactggctgcataaatcaacggtaaacccaccggggagaaactctcccggtggggatgtttctcccctttttttacaggagaaacatcatgctgaaattcagtgcaaaagacttaaaaccggtactgcttgaggcacgtaaaaaccactgtggcgtggtactggtcaaggatcatggcgtttatattatgtctgaaaccggtgagctcactccgcgtggccgaaaagtggcttatgcgaagggatgccatccagaaaaggatgaggcctggtgggataccgcccgggcagaagtagggggtgatgattttggtgagacgataaatctgacgaaaagcatgattaaccgcattctgaacgagaggaaaccgctgtatatcacggccagcaacgaagaatttaagatcgagtgttaaaactgagcgggtctccggacccgcgtaaaatcttaccctgacgggggtattcccgtcagggagcgtgcacgaaagtgtgatgaattatcaacgacagcattaatccttctggatgatcaattgtgcgtatgtttttgatggatcggtgacatctgcctgatctgtctgttgcacaattttccatccctcccgggcaagtgacgggatagttccggaaatgctttcgccgcatttaaataccgtgttatccgtcaactcggcattcgctgcagagttcgctaccgtctgtgatttacaaacgtgagcttctcctgccagtgccggtccagctactaacagactggttagtaatagtacgtttattctcatttaaacctcttttgttaacatgcacattaaaagaatggttattggcactacgatagcagttcttcagatggcaatgtattgattttcaaccatgaaattcagcctttttcactgagtctcaatgagctgattcagcgcaatcgtgcaacaggtaattcagcccagcgagtggtataagctggagagagtagctctcttttcatctgccactcaggggctatccctcttccggcaaaccacacttttcccatacctgaatggttgatactgtcgagaactttcatcaactgctcacttcgttcgtgcggctgcacttcatcaaaaagatttaactgagaaatcccggttggtgtgaaatcattgagcatgcaacccgcttttgcatatctatgccctttcacccagatccgatccagtgctttcaccgctgcggctatgatgtccctggtatcctgcgtgggagtcgtcagtttctcactggccacattcccgtaatacggttcgttcacagcgaacggtgacgtcttcacaaatacagcaacatgtctgcagaattgccgctcgccgcgcagcttttcagctgcacgctcagcatactgacagactgcctggcgcatggcttcatatgttgtgacgcgctccccaaaggatcggctgcagacaatctgctgcttgggtggcggagcctcctccagtgaaatacagctttccccgttcagttcacggacagttctctcgagaacaacactgaaatttttcctgataaatgttgggttcgcgcgcgccagctgcagtgcagttgttatccccattgtgtgcagtttcttcgagatccggcgaccaaccccccagatttcgtctactggctgcagtgacaatagtttctccgttcgctttggattgcctgaagtcagagcaagcacgccctcaaactgccgccattccttagacgcccattgtgcgctttttgccagtgtcttggtcggtcccatcccaactccgatggtcagtccggttcctgaatgtacatgctcgcgcaactgccggccgaagtcttcaaaatcgatacaactgtcaatattgcgcacatcaagaaacatttcgtcgatagaatactgctcaacgcgaggtgccagttcttcgagatgcgccataacacggttcgacatcgacgcgtagagttcgtagttactcgagaacgcaacgacaggtacaggaaattcggttgttttcagttgaaaccacggaacccccattttaatgtccagttgcttcgcttcttttgaacgcgcgataacacatccatcgttgttactgagcaccacaacaggtgtattacgtaaatcgggacgaaatactttttcacagctcgcgtagaagctgttgacgtcagccagggcgaacatcagtctttactccgggttttgtgtacgaatgcgatcactacaccgaatatctgcagctcttcaggatagaggacagggtatgcaggaatttcggacgcgggttcaactcccgccagcccaccaaataaaacaatgggttacgtgaaaacgtagtccctttttctttggtagtggcgacaaaatggcggcaagcatttatcgattaaaggactacagatatgaataaacctctaatagccttattgctcatcaccagcttcagcgcatctgctgacaaaatcccatcttctatccaaaacctgattgctgtttacgataccaggacgcacagcctagaagatggtgggctgactatcaggtataacaaacgacttttgctggtagatgcagctgaatcgatgttccaaggcatctgtaatgattattatatgaacaagtggaaacctggcacgatcaagagaattacacttcttaatgtcactagcgatcagggctttgaaatcaatgctggaggggatgagtgtagaaaagctggcacaatgaaagacgagcaggcgcgcacctatagaaccagctttattaaacctcttcaataatgaagtttaatgaaacccatgattttctttggtttcttgcggcattcctcccttgtctttttgagtaagaatgccatcaacttaccttaaaaattcatgtgcccttgcccactcactgttggatgtggaggagcgttatttaccaatgctggcgtaactataaagcgcactaccgtttcatgggtgacaaaggtgctaccacagttaatgttctggcactggcagtaacgctcttttgtgctgtccgtaacctgaaagctgctcctagtgtgcgctgagtgtccacactttggacaattcatcattttgagtttctccgccgccattaagttctcaataatgatacacaagaaattattattgagaacttatttattctatttctaaatcatcaatctttacttctagctccagactggtagtaaaaccattatccgggctgaccgtatgcgtcaacgttgtaatggtccattcggcatcgtcgataggctgcttaaaaccgctcacctttactggcatttcggtgtagagatctgcccgcccctctgcgagctgcagggagaaagacgcaacaccacgttgcaggcgctcccattgcatttttgccgcacgctcagcgttgccgcggttggcgtaggtacgattaagaaccagcacgttttcatccgttcccaccagataatcaccctgttttgcttccggctctttgggtgtggcgactttcttgtgacggcgctttacctgcgttgtttctttcttctttggttcacgtgtatgcagccaactggcaataacgcccgtatacgcgccacgatcagccaaggtaaaacgatgaccgtcaccggctttgcgcgtgatagtgataaccggcagcggcttgccgctcgccgttcttccctgtccctgccggataaacagcaggttcccgtccttaacggaagcaatcgccccatactgtctcgccagtttcatcagaaaacttgcatcgctttcattggtctggtccatatgatccagcaccttatccgtcaggtctttacccagcgccactttgaggttatgccgggcggcgatttcctttaccacctcccccaccgttgtctgatgccatgatttttcgcgccgggtattgagggtttcacggaaatcagcgctacgggcacggatagtcagacgatcaggagcaccgctgtgctcaatctcatctaccgtaaatgccccttttgggaaaagcggctggcccttccaccccagcgccagttgaataacggcaccacgtcgcggcagaacgatctgcccgtcggcgtcgtccagctccagatcaagctggtcagcctcaaaaccccggttatcggtcagcgtcagactcatcaggcgcgcatccagcgcggtggtcacgtccttaccttcaatagtgatactgaaagccgggcttctgctgttcaggccaaaaagatcagagctaaaattcactgcagcaaccctccaaccgtatttttaatattacctatcgcagacgttgcagagtcctgcaggttactgagctgatcgctgagactgccgaacatatcagacagcgactcatcaacccttttcagggtcagcgtaaactcaatacggcgagacattccgctttcaaaaaactctgtttttgtctgactcaggctctcgatcacaaacatgccgtaaatggtcccacttccctcaatcaggggccatgctttgccaagctctgccatttgctcaagtgccagcaatgacagcctgccgccggtgacttccggcagcagtacgccagataacgtcagcgggtcattatccgggccaagaaactgcgttgatggtcgccggttcacccgactgttggcggcgtgtcgccagcttcgctgatactgcagctcctgatatggcactgtacgcagcatgaagacatataaccccagtaccatcatcattattcatatcccccttgatcactgaaattactgcgtgctttagccctggtcttgcgctcgcgttcgtcaagctgtcgggcaacttcacgggcaatatcctgcgcactctgccctggctgagcatagatagtgatcggcgcgtgagtttcaaagtgcatcactggcggcgcgctggcagatttcgcaggctggctttgtttatatgccgcagtaggcagactgtaaggatgtagtggagcagcctctgcaggcgctgccgctacgcccatgacacctgcaacgatggaagccaacgcggcagtgcgccgcctactggtcacttttgcggggccgttcacaatttcagggccgttctccccaacaataccgaactgaccgcgcggaataatcccaccgctgtcatacatcccggcaaacggaacagcagcagccgctgcgccaccaaccacctgcacctgtgctttgtcttgtgttttattattttcagtcatccagtcaggcagataatcggtgactgaggaaagcttgcttttgagtgtctcccatttggcattaattccatcgagaatgctgtcaataatggcgctgcccgtgtcctgaaacttcgcaggaagcgcggaaacatcagccaggatcgcattccatttatcactgatagattgtctgatattggcccacgcctcagaaacgccagattttattgcatcccaatttttagctattaatcccggcaaggtataattaaagaacagtgacttaatcccctcccacgcggcgctggccttttctttaatccaatcccatgccgtacctgtggcattacatacggcatcccacatggccttgaactttggcccaagcgtgtcccagttctgccagatataaatagcaccagcggcgatcagccctatgacagccagtatagggtttgcaaacatcaatcggcccagccataaaactgatttcccgagccctcccagcgcagcacgaaccaagccacccaccgacgcaaacttcaggcccaacatgcccgcgctcactctgatgattgccatcggaccaaggattgatgccagcgccaaagagatagcccctacagccgttgcagcaacggcaaatcctgcagccatcttgaataaggcagacgtaagcgagggatggcgtttaacaaaaccgtccaaacgagaggctaactcccccagccaatcggcgaggttctttaatgcaggtgctacggtttcaccaatactcgccatcgcattagtgaatgtcccggtagcagcctcccatttattccccagggtgttcagcgatgcatcaacacgctccctaagcgatgcctgattttcaagctttgctgcagtttctctatatccttcaatccctttagatagcataatgttcagcgcttgtagcgtttccgcatcattgccaaacaaatctttcatggttgccatttgggtttctggatttaattttttaagtttctccagctgggcatacatattttccagaccaccaaacccacccttcccgtcagagaagttgaatttaatacccgcgcccttttctttcaggtcatcgttaaccgccttaatattgtcagcatccagagcggcctgaaaaatctttcggtatgcattaccggcagactcaccagccatactcccctgatcagccataaccaacaaaggcgcgaaagttttgaccgcttccaaccccttcttattgatgatattcatcgcgctgctgatttttgagaaaccctgcagcatatttcctgaatctacccccgcgtagaatcctttctggatcacgtccatcagattcatcatgtctttttcggaggtctgagtagcatcttgtaacttagccgcaaactcagctgctgcagtgggagccatctgtaactgcacgccaagataagctgctgactctcccaagcctcccaggatgacctgcgccgacataccctgacggcgtagcatagtcatcatgttctgaaagtcggctgttgttcccggcagcttatcacccaaagcaactgcaagccggttaattttttcaaattcaggcgctacctttccgcccggccccatcatggaaccggcgagttgattcgctgcattttctgattctgaataggcttttactggagccagcaacgtcatgccagtagttaccccagccgccatcgcccctgcaccattacctgccagagagttccttaactcgcgggtcttttcagccttggctttgatggcgttgagctttcgctgacgctcgccaacttcacgcagcctgcgctcctgctcagccaactgtcggttataccgctcagtttctcgtgcaatccgtgccgtctcacgcgctccgcccccagcagataaccccagccgataaagctcagctctggctgccgccatctggcgagtttcctgttgctgtttttgttcaagacgtgaaacagcacgccactgagcttcaagcgcctgcgtttgtttttttgtcggggattccaaagaagacatttcgcgcgtcatcatttgagcgcgtagcctcgcctgatccagttcggcaccagtacggctaacactttgagttagctgatcgaaagatttaagctgacctccagcatcactcagctttttaatctgatcgcgggtttgtctaatagctgatgccagctccttagagccagcctgtgcatttttaaatgggcgggttaacttatccaccgcccccagaactacctgcagtcgcaggttattatcactcatcgctggccccgcttctctgaattgccttatgccgccactccagcacatcagtcagcggcataacgtcagtgatggacggcgaccagtgaaagatggtggcaatgtctgccaccagatcatcaaccgtcaggttgtcggcaaatcggcaagcaccgacttcggcaacaaaaaagtcaccacctctacagccattgctgtcagatcggcggggtccagctctgccatttcctgcgcggtcagcgtcggggaagagattcgcgggatcacagtcatcatcgcgcccacgtccatatccataatggcctgcagacgggtgccacgcagcgcgccggactgaggcttgcgcagcacaatttcggtaatttcagttttaccgcgcatgatgggggtatccagttttacggtcttttcagtcagcttgtcgctcatgttcgtttcctgttaatgaaatactggcgcggctgcccgcgccgttaaggttaatcagaggccgagggcattacggtgttcttccatcaggtccacgccgccaacgatttctaccatgttgaccagatcgacctcatagagcacctcaccattaatggtcagcttcgcgtagctgttggtactgctgactttggtgctgctgctctcgccggttttccactcgccggaatccacctctttatgacgcccgcgcacaaccagctcaacggcctgcacttcgccggtatcgtcacgctgaatggaaccggtgaaacgcaactggatgccgtcaacggttgccttgcccatctgcttgaataacagcagttcggtgccgccgattgaaaattccgtgtccagtgcgccgtcatccagccccatgtctacgtccaccgcgcccggcataccgccgccgcgatacttctcaaacttgcgggtgaatttcggcagggtcagggactcaacgatcccctgccagttgttcccgtcgttgaacaggttcaggtgttttaacttgcgtggtaaagccatgattcccccttatgcagcgacacggctggcaaaatcgaccaggtaacgatcggtgatgcgctggcgcagcatcaggttttcaagcggaggcaccggcgtgtagtcataatcgatggtcagtttcccggctttaagggtgtctttatcgttaacagactcatccagccagcagtcaccaccaatcaggtatccctggttgaccagactgcgcatcttggcgcgtagtccttcaataatgtcgcgggccagcgacggattaagcacgccatccaccgcccacatgtgcgcctccgccatagtgtcagccagcacctgcgccgtgcgggtgtagttctcaaaggcaaacagcggatcgtcactgagacaacgggacccccagaagcggaagccgtctttgcggatcaatgtggtgacgtcatttttgttcagcagtcccgcatcggttgccgggtcctgcagatcccagaacacatcagcggaaatgccggtgacaccgttcacacccacattggacagggttttatgccagccgatctgctcgtcgattttggcacgcaggccgagcgcacgggcggaggcgtaagccgtcgcgtctgctttcagcacggtgtcaaagttgatgaagtcaggccagatcagcattccctcgcgctgactgaaattctcgcgataggcaatagcttcctccaccgttttgcagccattagcagcaaggtaggcaaacccgcgcaagctttgcgccacgcccagcagttcagtagcaacggcctgagtgtcatgtcccggcacctcaagaatgcgcggcttgacaccgagctgcgactgcgccgacagtagcgctttcatgcccgttttcttaccgtcggaagttacgccgccgataatattggaggtggtttccgcttcggtttcgccctgcgccacacgcacaacgacagtcacgggttttgcctgatctgcaatcgcgtccagcgagcgggccagcgtgccggactcccccgctttaccgctggcggtgagcacatcagtcagcaggacaggcttattgatggggaacacggacgcatcagcatcatcgccggtgcagaccatgcccacgatggcagtgctcaccgtggtaataggtcgggtgccctcgttgatttcaacaacgcgcaccccgtggtggtaatcctgagccataaggcagtctctccggttgacagggataccttatgttctggttgccaggcgtgcggtgcacgtatttcacgatgtgtcagtgctggtacaatatcgccactttcaacgcgactgatttacagggaatttcttgtaaagagtggaaatgctaacatcaaaaagcaatccaacacgatgacgagtttcaccggcggcaagcaaccgtccggcctgcttccattgttccggggtgagctttggacgcctgccaccaatacgaccttttgaacgcaccacttccaacccggcgctggtacgctcaacgatcagctcacactccatttcaatgccagaacggcaaggctcctcctgagcgaaaaggactttttttgaaagtttctggaaaataaaaatagtactatttgtagcattaattgaatcagccgaatttttctaattcatcaatcagatggacatagcatttgctataaaaaataaaagtattcctgctatctatatataaatgagttatgtacatataaaaggatcattaccgtgacaaaaataactttatctccccagaattttagaatccaaaaacaggaaaccacactactaaaagaaaaatcaaccgagaaaaattctttagcaaaaagtattctcgcagtaaaaaatcacttcatcgaattaaggtcaaaattatcggaacgttttatttcgcataagaacactgagtcttctgcaacacactttcaccgaggaagcgcatctgagggccgggcagtgttgacaaataaagtcgttaaagattttatgcttcaaacgctcaatgatatagatattagaggtagtgcgagtaaagaccccgcatacgccagccagacccgtgaagctatactatcggcagtttacagcaagaataaagatcagtgttgtaatttgctcatcagcaaagggatcaacatagcgccttttcttcaggaaattggcgaagcagcgaaaaatgcaggtctgcccggaacaaccaaaaatgacgtttttacgccaagcggcgcaggggccaatccttttataactccgttgatttcatcagcaaacagtaagtatccacgtatgtttatcaatcaacatcagcaggcatcctttaaaatctatgcggagaagatcattatgacagaagttgcaccactgtttaatgagtgtgctatgccgactccacagcaattccaactgatactagaaaacattgctaataaatatatacaatacactccctgaacacagaaaaaccaaaaaatatgcggagcctcttcctgattaatatgaaccaatagtatccataattttccccaggaactaactccggagctaaaccgtcatttaccagtgctaaaattatacactcaaccatcaaaaaaaatagccattgctgctatataacatatagcagcagtctctactacatatctatatttttatatctgagctggtttctccggccagtctgggttagctgtatccacccggtttaccattacgctataaagttcccatgcttccagccgtttaatctcttcatctgtggcaattttcagttttaccgcccgcgccagtggcgcaataactgactctgcctcagcaagaagttccgcttttctggcttcagcctgtgcaaccagctcttcaggcgtatattcgcgatgctcaaccagtaccgggcctcctttcctgtgctcgatatattttccgtccacctggccctgcatcagctcgcgataatactcatctgtcaggggaattaaatcgtcagggtaattatcggattcggtatccggttgccagaaaaaacctttttctttaaagctgtaataatattcgctcattgatatttatctcccaatcgcaaaccaggctacaggaaaattattgaccagattggccattcctgatgacttggtggcggcaaaaaactgactgttgctcaccgggtatccgaatgcgttatccacctgggtgccctgagcgttggtattggttacaaaaacggcaaagcaaccaacagggaaagcgcgcgggaaattgtaggttccgtttgagttaccaagtgttccccactgcattataaatccggtgctgtcgtccagaatccagccccagtcctgaatgctgccggtatttttacgggcgaaagtctggttaacataatcaatggtggcgcgggtgttgatgttgttgtcacgaattgccagttcactattgatccagtcaatcgttccacgggtatttagctgattagtaatccagatactcagccagttatccccccacactgaactaaaaatgtcaccattagtggtcatgctcgcattatcgaaatgaatatcagtgagcatgtgtaatccgttaccattgatataacccactttggcaccgttacagtaaatatccagtacgccatccgcgctgccgataaatccactgtcactgtcaccgatatttatacacggtgtgctgccgtcaaaaacgccggttccgatattgcctatactcacgcgttttgtcgggttcagggtttcttttaaaccgatattttgtacaaaccgcggcttgtcaggaatgtctgcaccgttctgtgatttttgtagcgcatcggcggcacgatttatcgtttctcctaaaccgaagtatgcgagaaggccggcgacatcttttccgcttaaattcgtcagcgtattgtccagcggctgctttccaccaagagcgtttaacatcgttgtggcaaaattcgggtcattccccagagccgctgccagctcgttcagcgtatccagtgctgcaggcgcagaatccaccattgccgcaatagacgatgccacaaattccgtgttcgcaatctgtttagtgctgttacccgccgctggcgtcggtacctttggaatccctgtgagtgtcgggctgtccttctgcgcatactgtgaatgcgggtccggcgcagcaagatgctttgccatcaggtcgtctacatataccttcagctccagcgccttatcatctacatatttacgggttgccagcactactgcagggtcaattttcagggtgatgttatcggtgctgctggtaatcagcaccatgcgcacggtctgcgtacgtccgctcccttctgtcagctgcggcttgtagctctcagggcagttacccacagcgatcagcgcaccggtttcatcaaacaggccaacttcacgaatccaccacccgccctcagtttccgggattacctgctcagcaataatctggctactgttctgcgggtcgatataaagcatattcagcgcagcccggcgtttctcatttaccagtgccgtctgctttgcgtccggcgttggcaatactccgccgccatcgcccaccgccatatgggtaatttttagcggcacaccgagcgcggcggcgctggcaagttttgccgcgccaatatccgtcagcagggtataaaattttgtgctcatggattcactctcattgtgtcaataacatggaccgccccgccttcatgcgcggtgccaccggaaataatcgtttcgttgatatacggatagatcgtgatttcttcgccaagatagctggcggctcccacccaatgcgggccgctggtctgcagattgatggacatgccgatcatgtggcggctacatggtttggcatcgcttatcagtcgctcaagttccagataggtatcttcagtgatgccctggtcctgcacgccgatatccaggcgaaacgtgcccggtgcctctccggtctgccaccactcaataatgtggatcaaaaagccgaacggctccaccacccgccgcacggcactggtggtccctttatgctgatgaatataaaaagcatccttcaccacctggcgcttgacgctttctgtccagccctcgtcccagcgatccacagagaacgcccaggcgagataaggcaggaaactgaccggacaggttgccggattccacaagtcacgaagcggcacctgcagatcagaaatcccgctgcaggtttgcgccaatcggcgctccagtggtgttgaacccggtggcagcagactattcatccgttcctccgttggttacgctccactgcgtacatgatgccgcctgtgttttgttcaggaccatatccgccagaggagaagccagctccacacgctgcacaccctcaacatgcagggcggcaaagatggcgctacggcgaatatcccgaccaagacgcgtctgactggcgatgtacttctgcaggctggcttttgccgctgccattaccggctctgcttccggtcccggatagagaaaaatagtggcttccacccggtacgggatgatttctgcgctgcgaaccgtaagacggtcagccaccgggcggacgttctcactgttcagagctttttccaccacgtccagcaggtctttttctgctgttccatcgccttcgcggctcaggacagtcagcaccacctctgcaggtgccggactggttgcactggcatctgccacacgtccgtccgcacttctggcgtgaaattcataggctcccgtcgggccagcaaccgacaacccctcaaacgcagcagggatgcgctggcgtagcgcctcatcatcttccatcactgcggcgaccggcggtactgcatcattatcagcaggcactacagtcaggcgtttcacgttgcagttggctgccagctgctcaagatcatttcccatcgaataggccaccatcaccgcctgcgcagcctcgttaatacgctggcgcagcaggatttcgcggtatgtgctttcctgcagcagcttggtgacgggttcagattccagcgccagcgtgcgccgcaccgcgtcctgttcatccacaggataaagagccacaaaagcggccttgcgctcagccagcagcgtctcaaaatccggcacgtccactatctgcggcgcgggcagccgggaaaggtcaatcactgccattgtctgctcctgtagttaccgaaagtgaaaccggcgcgccgttgttgcgctgcccggtaagctcaaccaccatagagccgtcaaaattgccgttgatggtgatggagtccagcgtaaggcgcggctcccagcggttcagcgccacatagactgcagacataatctgcaggcgcagtgccgggttctgcggctggtcaatcagggctgacagtagggagccatattcccggcgagcaagacgactgccctgcggcgtcagcagaatatcccgcaccgactggcgcagatggtcggtatctgcaatgacctgcccgtcattcctgctcataccgatatacaacgtcataccggacctcccgatgtatccccgcctgacttaacgccagtgtgaccgtgtttatccatcacgaccccgttagaactcattgcgccgccgccctgggtgacgccgccgttgatcaccacctcgctattaatgcgtgttgtgtcagcctccaccacaaactcaccggtttttagggtgatattgtccgccgcctcgatcaccatggatttgataccccggacatgccacctcccggtggcgggttcgtactcaaaccagcccccgtccgggtactccgtcacgcagccgtccacagaatccgacggcggcgcaaactgattggagtagatggcgggcagcacaaaagcggtttccagattgccgcccatgctcagcaccaccacctgctcatccggcgacgggcaccaccatgtacgggcaccaccggcacgcagcgtcagccagttaatccagttagtttcaagctcgcccactttcacccggcacagccagttttcccggtccacttcggtcacggtgccggtgcggatcaggttggtgataaggcgcatgatttcggtcagttgtgcattcataacgaaaggttgccatcagagggaaaagggaggcagcgcgggcgcttgtgccagcagtggcacaaagatcaccccgccagccagcgcagcagagtgtcacgggtgatggtttccacctcatcattcacgcccaaaaggcggcgctctgcgtagcggacctccgggccttttcggctgacgcgatcacgcaggccgtaatggtgaacacgggcaatacgctgcaccttgccatcaaactgcacgctggcggagtccgcactggcggcggttttcaggtattttgtggtgcgaagctttgcaaacatctggcgtttgatacgtcccttcttgctgcgggctgtcaccctgcgcggctcatagccgatgccgtcaggattacgctgcagcctgatgttctgctgttgcgtccggcgcaactgttgcgccagttgccgcatcatacggttgcgtgcggcaggctccagattcgccagcagcgccgtcagccagtcatcaaccttctgcagctcatccacgtttcaccgtccacatttcttcgggttcgtccggctccggcaccgcttcaacgcttgacacgctgccgtcagtgctgaccagcacacgctcagtcagttgcaggttcatgctgatatcgcacacatcgtttcgcagaatatccacttcaaaggtgaacagtttttcgcgcagatccgggttgttgatggcgtccggctggctggtactgagccacagcaggactggggccatcagcagattctggtcgccgctgaaatcctcgatcaccacgttcagggtgtagcggtattcccatgacatggaactggctcctgttgccaccagtgatccgttatcaacgaaaaggtgcagcttgtccgggttgtcccggacataggcaaccactttattcagggcgctgcgtaaggactgcggtttgttcactgtctcgctcctgacacgcaataattgtgtccactttgtcagcacagaccgcccaggcggcctcggtttcatccagcaccgcattcagatcgccgttactgcgcggcgctgacctttccaggcggcactgcgtcactctgggacagccactcacggtaagctgcacctccggcgagggccgggcggtcccgcaacctgataatgtcagcaggcaaaggagtgtcagcccagcggcgtaaatcctcgttttcactttttagctcctcgatccggcgctggcgacttcgcaacagtgcggtggtctgctccgcagccgcataaagccgcgtctgctcccggctgttggtttcggtcagaatggacaggccgatcagctggctgtttttcttcgtcagctcctgcgttttgcttttcagcgccgcgccctgcgtttcgatggtgtggctggcattgtttaaccgccacgactgccagcccagcgccgcaagtgccagcgccagcactaccgccagcgcacgcatcaggccgccatcggctcatgaagctgcgagcgggcaatctgatacaaaaccagcgtcagcaggtaaaacaccagggtgatcacccatcccgaaaacgccaggcacagaacaataagcagcctgatagcccatgtacgcacgggttttacggggtgcgccctgaatttgattaatgccgccctgacctcatcgcgcgcccgatctccggcgaaccacccgacagcgcacagcgcagcaagcagccaggcgaggaagcatgacacctggacagacgcaccaaccagaaccggcgcaccgctgcgcggatacagcaggctgattaccaacagcgcagcccatgccagctggaaaaaaacgctcatgactttctttttcattccgttaggctccttttaagcaccaggccatttcccgcgcgcggcggttgtccagcccctgattaaacacacctttgacatatacccagcgcggcagctgatggcaggcatccgcccagcgccgctggttcagcaacttaaccagcgtggagctgcaggcgttgccggtgcccacgttgaaagcaaacgacaccaccgcgtcatagaccttttgcggcatcggctgcaccacacatttttccagcgcccgctccacgcgcagcacattggtgataagtccctgcgccgcctgccgttccgtgatggtttttccaggcaccacaccggacgtattgccgatcccgtcagtccagacgcccgcgctacactgataaggctgcaggcggcatccctcgtaatcggcgatcagtttcagcccctcaacggaggtatgaagcgactgaaatccgggcagcgtggctgcgatagccagcactgccccgacaaggcagcacttaacgattgaagtattcatattccccccgcgaaatcttgccgccacgtaacaatttgaaagactggtgtttgtagtaccagttgatagccagcatcagcacaccaatcagtacgccgccaaccgttgacgcatccttgagcgacagatcgcccagccatgccagcagcacggcaatgcagtaagtgataaaggcgctgattcgttcaagcgtcataattcagtcccatagctggacggtctgcgccgtggttgacgccgtaatgtccggcagcttcacctgcagcccgtgcggtaaaaatgggccgtactcagccagccttggatttgcctgcagaacctgctcagtgacaccctgcgtgcgcccgtaatgacgccagcaaagcgcgtccaccgtgtcatactgatgcgcacgcactttcatcagataagctccaccgtacagtgcggtgcatcctgcacccggctgatggcccagcgggcatcacgccacagatcgccgctggcctccgccagctcctcccctcgcttcacgcctgacgccgtggcgtcatagtcctgataacgctcattaagcacagcgcgcgcccagcaaaaaacagcgttgtggtagtgccggatacgctcgcttttaccgtccagcatttctgcgggaacctcagcaagtgtccgccagcccagcatctgctgacggttgcggaagtcgtacagctcagcgttaacctcagagatcgccgtcagcacgacctgctttaaacgcggctgcgtcaccgtgccgtcagtgcgcatcacactgcgaaattccgacaggttcacatcaggccagaacggcgtatttttgatgacctccgcctgttccggtgcctgttctggcgcaacaaacttcatgcggcgttctcctgaataagtgggcggtggacggaattttgatgtggcagtgcctttcgccatcccgtgccgcccgtgcgcggggcacgttcgttagcggctgtcattgcgcagtctgcgctccagctgctgcttttcttttttcacaccgcagcggggatcaagctgcagcgcatggttaaggtgattcagggcagacgccgggttgctttcgctcagtacagcaccgatggctttatgcaggcgcgcccgcgactggtccggcatatccagatcggtggtcaggtccagcgtctgcagaagcggatcggcatcaaaaccggcagcggcaagcagagcgctttgcgccgcgtctgccatttcttctgccagcacggtctgcacgttacggttgcccagaggcatcacccagccatggcgcagcgcatggcgcccgatttcgagcgcaccggcataatcaccggcgtcgatacgccacagcatcacgtacatcagcacgtcatcctgctgcgcacctccggcagccagcacgccctccgcccaggcggcatatttcggcagcagttccaccttgatttccgcctttttcaccgtggactggacgcccttgaggcggcggcggtcttctgccagctgcagcagcatcaggtcatagcccgacgcatggcgaacactgccgccctcacgggcggcctgttcagcctgaatgcgcaggcggtgctgccgtgcgggactcaggctcatgcgttattccccactttccggtgcggcaggcgcgctgaaatcaccgatttcgatgttttctaccagcgccgcgcagcggtagtcctcgaccacatacgcctcgttgacggattcaaagttttcaatccggtcgcgtttcgggttgtcgataactgaacggcggcgggtgtcttcctgccagtagatggacaggttatccagacgggtgatcagcagggcatttgccgggaagaaaggcgcgcgcacagcctgcaggccgcccatgcgtttctggctgatgatcagatcggcggcgattttctcgctgttgtcctgctctttgttgaccagcgggaaatacttgtcagacagcagttcacgtccgcagacaacaaccagctcgtcatcatcctgatactccacatcgatcagctcgttgacggtatccatcaccaccgcgtcaagatttacatacttaccacccggacctacttttactggttctgcagtagtggtgccgtcttctgcggttttgctgcccatgacgtgatccggcgcgtcttcgcggattttctgcagccagcctttattgacgtcctgcagcagcgggttttcagcacggttggaggttttggcgcgcttcacgccgttaaagccgatcatgatgcggtccagcgcctgacgcttgacgatggcgttgcggatacgcacctggaagtcctggaatttcgcccacaggtccagttttgcgtaggtcagcaccgtatcaaagttggtctgctcgcatttgtattccacgtcttccatcagcgtcggatcggtaggctcgcgctctttggtggtggtatcggtggttccggcaatggtgctgccaacgcccagccccagcaactgaccggactgctcagtgaccggcgtgatgttaatcagcgtcaggaaagcagcagactgctggatgtggtcttccagagtctgctgcacggacggctccacggtgaacttgctggagagttcttcaacatccacaccattcaggcgcgccagctgctgcaggtaagcgttaaaggcaaagcgggttttctttttcatcgggttttatgctccatcagcaattggtcagggtgcctgccggtgcgtcaccgcccggcgcgcgctggcggtaatccttgcggctgtcttcgcggctcagttgctgctgtagctcggcaaaggcggtctgctgttcctgcagggaggactccagcgcggaaaggcgctcaccgttttcagccagggatttatcagtgcgctcgctcaggttctgctgctcggtggcgacaagttccacggctttatgcacatcggagaaacgcgcatcgtcggtctgctcttttttggtgaacagcgcggtgacgctggcaaagagggacggcttttcgtcctgggcttcttccagttcgatcagcgtttcaaccgcttccgaaaacaggttttcagggttctgcttacggtttgccagcgggttatgtgcggcgctggcgctgaaagccagcatttcggtgccaaggctcgcaggatcgtccgtcgcacccagccccacaaggtaggctttgccggtgtcggcaaacttcgtgctgacctccatggaggtgaaaagcttctggccttttttcaccagttccaccagggcgtcagtgggttcgatatcggcataaagtgccatcttgcccgccagcgggccgtcctggatttcttctgcaaccagccccgtcaccctgccatagcggttaaaagtgctctccggcagataagacttgatgtgctcaaggttaatcagcgcggtatagaccgtcgggttgtagctggcagccatctgtaccagccattcacgctggatctcgcgcccgtcagtggtggcaccttccaccccgatgcggaaacgctttgctttcactgtcatgagccgtgctccgttagaaataacttactggagtcttatgtttgcggtgatggggggagtgagacaacgcgctgtatttgtacggtaaaccacacaaaccgcagccggggaaagccgccatccaaggccgtatgtttgggccatgaacacgacactgacccccgcagacctcgatccccgtcggcaggccatgctgctgtactttcagggataccgcgtagcccgcattgctgaaatgctgggcgaaaaagttgcaaccgttcacagctggaaaaaacgcgacaagtggggcgactatgggccgctggatcagatgcagctcaccaccgccgcacgttactgccagctcatcatgaaggagcagaaagaagggaaagacttcaaggaaattgacctgctggcgcgccagtcagagcgtcacgcccggatcggaaaatttaacgacggcgggaacgaagcagatttaaacccgaaagtagccaaccgtaacaaaggtccgcgcaggcagccggaaaagaacgttttctccgacgaacagatcgaaaagctggaagaagtcttccacgcctcaatgttcgactatcagcgtcactggtttgaagcaggaaaaataaaccgcatccgtaatctgctcaagtcgcgccagattggcgccacgttttattttgcccgtgaagcattgattgacgccctgctgaccggacgcaaccagattttcctttccgccagtaaggcacaggcgcacgtctttaagcagtacatcatcgactttgcaaaagaagttgaggtggagctgaaaggcgatcctatggtgctacccaatggcgcagcattgtactttctcggcaccaacgcccgtacggcgcagagctaccacggcaacctgtaccttgatgaatatttctggataccgaaattccaggagctgcgcaaggttgcctccggtatggccattcacaagaaatggcgacaaacctacttttccacgccgtccagcctgacccacagtgcctatccgttctggtccggcgcgctgtttaaccggggccgagccaaagcggacaaggtagatattgacctgacccacagcaaccttgcacgcggcctgctctgccctgacggacagtaccgccagatcgtcaccgtggaggatgcggtgcgcggcggctgtaacctgttcgacctcgaccagctgcgcatggagtacagcccggacgaataccagaacctgctgatgtgcgaatttattgacgatctggcgtcagtattcccgctcagcgaactgcaggcgtgcatggtggacagctgggaagtctggaccgattttcaggcgctggcgctgcgcccgtttggctggcgcgaagtctggatcggttatgacccggcgaaaggtacgcagaacggtgacagcgcaggttgtgtggttattgctccgcccactgtaccgggcggaaagttccgcattctggagcgtcatcagtggcgtgggatggacttccgcgcccaggctgacgccattaaaaagctgacacagcagtacaacgtgacctatatcggcatcgactcgaccggcgtcggtcacggtgtttacctgaacgtaaaagacttttttccagcagtacgagagtttgtctacaaccccaacgtcaaaaacgccctggtgctcaaggcgtacgacattatcagccaccgccgtctggagtttgacgccgggcataccgacattgcgcagtcctttatggctatccgccgggccaccaccgccagcggcaaccgcccaacctatgaagccagccgcagcgaagaagccagccacgcagatttggcctgggcaacgatgcacgcactgtttaacgaaccgctgcagggcgaagccgccaataccagcaatattgtggagattttttgatgagtgaacacgacgccctgaccagcaccgcgccagtgcaggaggccgaacagcagaagaatacaactcacgccgaagcgttcagctttggcgatccgatcccggtactggaccgccgcgaactgctggactatgtggaatgcgtacagatggacagatggtatgagccgccagtaagctttgacgggctggcgcgaacctaccgcgccgctgtgcatcacagctcaccgatagcggttaagcgtgacattctcagcagtacgtacatcccgcaccgcctgctcagccagcaggcttttgcccgtttcgtccaagattatctggtgttcggtaacgcctatctggaaaagcgcaccaaccggctcggcggcgttctctcactggagccagcactggcgaagtacacacgccgtggcttggacctcgacacctactggtttgtgcagtacgacctgaccacgcagccctatgaatttacacagggcaacatctttcaccttatggagccggatattaaccaagagatttacgggctgcccggctatctctccgccattccgtcaaccctgctcaacgagtccgcaacgctgttccgccggaagtattacatcaacggcagccatgcggggttcatcatgtatatgaccgatgcagcacagaatcaggaggacgtgaacaatatccgccaggcaatgaaaagcgccaaaggtccgggcaacttccgcaacctgtttatgtactcgcccaatggtaaaaaggacggcatccagatcatcccgttgtcggaagttgcggcaaaggatgagtttctgaacatcaagaacgttagccgcgatgacatgatggcagcgcaccgcgtgccaccgcagatgatgggcatcatccccaacaataccggcggctttggtgatgtggaaaaggccagccgcgtgtttgtacgaaatgaattaataccccttcaagaaaggattaaagaactcaatgaatggttaggggatgaagtcattagatttgcgaaatatacactcgacgacataagctaattttattataaaagatggtgccatcatataacgatgacaccatcgcccctaaaatttatcaatttccatacatgaaatagcatcattgaaaatcgaaaaatgctcatcaggaaccactgcagaagccccactggttaattcaaaactaatctttgaatcaaggtaaaaccctcctgcttttattttatcgagcttgaattcactatccccaacaaaaatcttcaaatcatgcaaagcatcgccgctagaattcaattccaaacatgctcttgttttttcagtaacaggaagatttgacaccttcactttggaaatgccaaacacctttacgccgaaattttctcgaatgaccctcatgaaagctttaagatctacggttaaattcccataagcaacatttaacccttcggcctgagacaaaaaatcgataaaaggtttaactgtttttggaggattgtaaaaagttaacaaacatatcttattgctgagggtttggatagaaaaactaatctgatcaaatacaaccctttcgaattccagcacctcaccaaatggatcggcaatcggctctaaaacaacagattttttattgaaagttgcagtcataccattatgaatggtttcatacttagtaaaaccagcaccaatagcatcagaataaggcgtgtttttgataaaatcaaagacagcttcagggctggtcctgattttcaatctcatccacttcaatcttaattgtgacatagccactccttatgatgtattagctgatttccattataatagaataagctctattttcaattaatttattgaatcgctcagtttctctaccagagagtttttgcggcttactgaaatattgtccgtttgccttatattttctgactcccttaactaaatatgagaaattagtacaattgagaggatcaccaaattgggcctcaagctcaaatatatctggatctgccaagttctccttgaccttccattttattttccagatatagaatcctctatcataaagatcacttaattcatcagatttaagtaccccctcacccctaagtgatgccctagacacatgcactccagtttcggtgtttccatcttcagcctctatagtttcaggcttagggtgatatacataagcatcagtaacatccagtaactcatagccatcaagtgtacggattaatttatcgaagaataaagttctaacatcagcagatgtattgtgagagagtgaaatttcgtttaattttaaatcaaggttactatcatccgcttgctcgttctgaatagcgctgatgtgccccagtaaaagcccctcgtaatcgtcaaggttttcattatctggacgacggatactgtaaccatcatcaagaggctcaatttcaattaacgcctctttattaatagcctgtttgaaatcactttttccataattagttgaaagatatctaatattaatcagaactcgcggcccatccacgattattttacaataatcatcctgcccggtaatttctttcttaagtttttctgccgcgtctataatacctttcttatctataccagtctcaattcttacacatgtaattttttcggtccttgtctggccacctagcagggttgcaattttttgatgctcgtaataatcatgagtcattcgagaatagtttcttgccaattcctttcgaggagtttttttacatataatcgttcctctctctaagaaaaggtcttgaatttcatttagggtaatttgcttttggtttaaagcatcatacaaagctttatcagttacgctgtgaatatttttcatttcggctcccaagaaataacttctgcagagaagaattcttttactgtagacacaactttaacgtctaaatcttcaagcctctttttagcttcttcatctaacccatactcatgcgcatatttttcaactccccgttgaaaatgggagagaatcctctcatctttttctcgatatgccagccttatcctaattttatttataccatcaagaatttgataatttgacaaaatatctaacaaataaaagaattcattgtcgctgttaccttttttgttgtaatacacaacaaacccttctggataaacttcctcctcaatacctttagctctgttaaatttataaacagcaccatgtttgataaccatgaaaggtgatgacaagacttctatagtagctggaagatatttttcagtcacagcaaccttatgaaaagtcaattgagggtaatagaatccatattcttcatcaggaaactctttcttggcaatcaaatcattcatatcattcgttattgccaacatataattaatcagaaacggatcgattatatgaatttgctgacctgcggataaaggaatcttttctaagttgacagccttatctcttcttcctttagcgggtttgggaggattaaaaaactcataaaaatcatgctgcaactgattatcatgattaaaaacaaacagtaaaccgcgaacttcacagtcaatttgagaaaaattatatttttctgaccactcaggactatagcgagcacattcaatagtttttgctaatgacgccaatgcagattctatttttgacgcatttattgaacctgctttataactttttaaatcagtatttaaataaataactttgtttaaatatgggtctttataactaaatacaacatctacaggatgcgtgtgcttctgcttcttaccttcaggcttatgtttagcctcatcatcacaaaggaaatctcggtcgcaggggccatgctgctgccacttaaatcgactcagtagatcctccgatatgcgtttcgccaaatcttcaatagggccgttctctgccatttgatttccttacttttttgcagacaattctaattgaaagataaaggtaagcttttttgcttgcaaggactttggacctaacgtgagacgctgagcgcgcgctcgtatccccgccacgcctgcccgctttgtgtagtggttttcatgcacctgcatgacataagcaaaagcccgccagttctggcgggcctgagcaaaaacgatcctcaaacgatcatgcgatttcatgcggcatagacatgcacaacagcgctaacgcctcacgtggctcgttgttcaaccttgcggacggtaaaaaccagttttatcgtccgcaacgttcgctaatgtaaccagctgtcgtcctcccagacctgctgcattatttccatcactcgctttttgtcttcatccagttttaacccgctcagttcaacaccattggcgctgcccttgcggatacgaattgctgttttgggatacagagggcgcaaattacggtaaagctcggattcaagggcgtccagtgtagcctggctaatcttctgctctttatcgatcattatttcaatgcgcatacagatttcccttaactggttacgtccattgaccggcagtattcatggctgcggattttcgccatcagctcgtcggtcagttctgacacccactggatagccagccgcttttcttcgtcgctgcactcactagccgctacaagcttaataaaaaaatcaatgcgctggagcttcaacgactccaaaatatagtcctgcatcttccctcctatcacgacctcggatacgcattaactgtatgtatatccactgtttatatatacagtgtacccctgatatccaaaagtaaaatattttttatccgtcaatgagaacgttcttacgaaggtcgttaagagcatgaattgttaaagccttgccgtcagtatcactgacgccatttgtcatcttcctgcagtcgatggttgcggtaaaaaatccgtagcccggcacctgacggaatgctgccaccacgcagaagcaaatcaatctcagatgcactaccttcaaaccctctggctgtcagttctgcctcaagctgcaggcgttgctgctccgaaatattctgtttgtatactgttttccgcttcggttttaccagtctcaacctggctgtaagttcccgccgttccttctggcccatattgtggagataatcctgcagttccttctcattcatggttttaatatcgggtaaatcaccccctgatttgttcagattttcaacagggggacagttattgccacgagtccgagtccaaggggcgcaagcgccctggtcggctgccgcctcctgaacgtcaacggctttacgaacctttttccacttcaccgcgtgcgtgcaaatcttgccctccgcaatcggggaccagatgccatatatacggataccgtgatcgccgtaggcgctcggctcatcgttaagctcatatgccgtgcggacaaggtgatgtttgcggggaaccagcacaccgccctgcttcatgatataggtggcaaagcagcccgcatcagccgccgccagtaccgcatccagacgcggattatccagtaccggcgcacccgctttgcgttcgccctgcactctcgccgcctgaccagccagcaagcgcagctcgcggtatgcctgacgccccggaataccaaagaaacggaactgctggacacgatgcagtgacgcccaggcgctgacatgctcggcgctgtcacgcagtgatctgccggtttctttgctgatttctttagccagcccgcgcccgtcgatgttcttgctgatgtatttggcgatgtagcttgtcggcgtacccttgcgcgggttgattagctcgggcttgaagcgcggcccggtattggcgcccagctcctcgcggtcttcacggatggcaaacttacgcaacagcgcggtgatggaacggcggtcttttttgcgcatgaagcacagaagatgccagtgcacggtgccgtcatggtgcggctctgcaacgcggacgccataccagcgcagcccggccttgtgcattgccttgcggaaagcggcgaacgtatcaaccagatagtcactgctctgccggacagtggcactggtccacttcggattaggcctgccgttgttgagggttgcgtggaagcgtgacgggcaggtgatggtataaaacaccgcgcagtctccgcgcatttccgcgatcagctccagccccttaacacaggccatcatttcattacggcggtgcgccgggttgctgttgctggcgttcaccacgtcttccatgtccagcgtgtcgccgtcttcgttgatcagctcatgcgagcggaagaactccagcgatttgcggcgctgctcgcgtttgtggatcacggcttcgtagctgacatacggtgaggctttcttgttgaccaggcagacggcgcgcaactgctcctcccgccactcgcagcgcatctgccacaatttgcgataccaccagtccgcgcacagcatacgggccagcgacggtgggatcagttcataaggcaccggcttacggcggcgctttttgcggcgcaactgctcaaacgcaggcgggatgacctcaaggcgcatggcctctgcagcaaccctttcccatgcctgacgaatttcttctggtttaacatcatcactgacaaacagatcaccgcaggctgcatcaagacacatgctcatatgtgccgcaaccagcgtggataggcgtttaacctgatcctgattcatttcagggagtaccagcagcccctccagcccgtcatgactcgccatgaaccggaaagaggcagatacctgactgtcgcgcacgcgctccagccgctcaagacacggcctgattgttttttgcaggtagcgggaataagcttttgctctgcccagactatggaaatatttaatccgctccagcagaggcttgctgatatgcgccggttgggcgcccacgttggcaataatgaccagatcgggattaaaacgctgctgctcgcgcgccgttttggcatggttaatcagccgatcctgctccatttcgcgctggacaggatcacgggattcattgaagaaatagcgctcccagacctcatcgctcagcgtctcacggcgcaactgctcctgctcgttatccacagcgtaaagagcgatcaggtttgaaagcgcagactccggcgcaaattccgccgggtccagatacgggttaaccgctttttttggggtattccatggaaaggctgcggcggcctcattcgagccgccggtggtttgtgcataatgtaatgtgattttactcactgccacgcccgcacctcagtttccaccgagacatcaggaccagacgccaaatcaacaccgaaccagcgcactaacttcgtagcgatgatttctgttgcagatttaccatcacctgcagccacacccatgctgcgctttgcgatgatgcggtggcgggtgaaattacgatataaggaacgtgtcagagaggtgtcgctgttggacacaataatcggatgaccttctgatgaccggcgttcaagaatagacgccagatggtactgatcgtccccggtaaaactggcagtgtgataaccgctaaatgtgccgtcatatggcggatcacaataaaccacatcccccgcccgcagcattgccagcgtctcatcatagctggcgcagataaacgttgcgcgttgtgccttttttgcaaaagcacgtatttcgttttcagggaagtacggatttttataattaccgtaagggacattaaaatgaccgctcaggttatagcggcacagtccacgataaccatgacgattgagataaaggaaatatactgctttcatgaaatcagtaatttcagaggaatgattaaattcatgcctaatgttgtaataagcaacttctctattcgcaatcgcaaaaatattctttgcgcgtgatatgaaagcttcacaatcaagggcaatttttttatagagattgataagatctggattaatatccgcgacaagataatgaggatagtctgttgccatcatcacagcacaggaaccggcgaacggctccaccagtcgctgacctgcaggcagatgcttaatcagttccggcatgatggcggttttatttcccgcccatttcaggatggtgctcatttagcaccacctttagccagagcacggacaagccctaacgtcattttgcaatcagctaaagcacggtgcgccttaccttcaactacaacaccttcatgcgcagcagcatcaaccagcttatgccatttatagccattaaatcgtcccggctcgcctcgatactctgcataaagcttcatcgcgcaaacagaatgagcagcaagcatccatggcgcaccttcagaaggtctttcattcaatgcgtaggtctgacgaattaaccggagatcaaaatcggcgttatagataacaaacccaaagcgccgaaatagttcctccactgccccgcatatatcagtccaggcaggggcaaaagcaaccatttcattagtaattccatgaattgctattgcttcatcagggataggcttagtgggcttaataagcgtattaagcataataaacccatgactatcaataatgcatatttcaactatttccgcatcatcacccaacccggtcgtttcggtatcaataaataagtagtcattatcaagccattgatttgcacgttggctaattgtcatcttatcggtattcatacagcacctccattgtagtgtttgcctttcagctctgcgatttcctgacaggtgacgcagcactgcacgcccggaatggcgcggcggcgtgctggcgggatcggtgcatcgcaatcaatgcagagaacacgggaaacgcccggcgttttattgcgggcggtgtgaatgtggcgctggcgttcttcttcaacgcgctgctgtacgaggtccattgaatcagccatcagtggatctcctgcgcttcgttctgaatcttcaccgcttcctgacgcagcagctcagccgcttccgtgtggttaagctgacgtgacacgatacgggcagccaaagagtccagacgtgctgccatcacatcagcgcgtccacggcgttcttccatgcgtgcatcagtcagcatctggttaaggccagcatcatctggtcctgttttggtgattcgggtttcaatatttcgcattgttgtttctcctgaatttgggcaataagaagcccggcgggtttacgcctttaatttcggttgttggttaattcggcatggctagccgatttggaaataaactcaccactgtacggaaatggttcattgctttaatcagctcccgcttttcgtcagtcgtcagttcactaacattgacgctatgacgttccgccggaatctttgccataaagaatattgcggctagtgcgcgtttattctgctcatggttaatatcccgttggtcccgcatatcgctaataaagcgatccagttctgaatcaatatttaagccaaacactttcgcccttaattccgcgatgtggtttaacccattaagacggaggccagcgcttagcggaacagtcgcagcatcaccttcaatagccatggtttcccctgctttttagcggacagctcagccagcaacgcatcctgagagcggcacggatgccagcgcttgccatccttccccataatccagccatgaccgcagtgcattgcaggactttgcttaacgagaagtgatgcaaaagatggttctttagtcagcatagccacctcagatcagaccgaatgaagcgccgaggcccgtcacggtatccaccgcgcttgccatcgccgggttagcctgcaaacgtgcctgcatggaaacggcagccagtgccattagacgagtaactgagttgatgctactgataacatcgcggcggcctgcagtagttttcacatcacccgatacagcaccggcagcaacacgtccgatttcagcagtagcgctcatgacgtaatgcggcagcttctcttttgccacttcgttcatcggtatgcatggcaggcagtgaatctgtgccaggaaaccatctaccagcgtggagtcctcagtaatatcggtaagcagccagatctccgacggcgtgagctgatgcggttgttccgggttcagcttgttacgcagcgtctggactttcattcccgcgcgttctgccagcttcgccatgttgtgacgcagcgcgaaagcccggcaggcttcgtcaaagtgtggatgtttggaaatcttataatcaaacatgcaagccccttagaaagttctcataatcgaacttactgaccaacaatgacgcggaagttggaatgacccagagactcacgaacctggtcggttttgtacatcaggtaccgcaggcttacacgtcctttatttttttctttcttcaccatgtacttagcaagctgaccatggtgaattttttgatacaccgagccacgggagataccttcccactccgcgaactcagcaggcgttgccatctcttttggtacacgaattgaaatatcagtactcatagtgcagtatctcttagtttgggttcgttttatcttgttttatgtggtttgattttacttttcaaaccatgagcggatattaagatcactttttatatacgtcaagaggtttgattatgagtttaatcaaggcagggaatgatagtggtgggcgcgatgcgattaacaggcttattaaggcttacaatttcagctcacgacagcagctctgcgaacatctggaagtatcaaaaagcactatggctaacagatacttaagggatagtttccctgctgaatgggtaattcaatgcgctcttgaaacaggaatttcccttctatggctggctacgggccaaggagatatgtatgcgtgtgagaacgaagaaagaaatctcaaaaacgaaacctccgtcacggtaagaccactttctaaaattgttgctcctagcatcaaacatgttgaactgaagaacggtgaactgcagccaagtgatgaaattcttcttgatagcagactgctcgatggtgactcatccaactctttgtttgtaaaaacagctactgatagctttgttgtggatacgtctgttaaacaagtcagtaatggcttctggttagtcgatatggacggagttaaaagcatcgtcaaaatcgctcgcgttccaggcaacaaaattgtagttcaccaagatgaaacatcatttgaatgctcggtcgacgacattgaagctatcgggcgtgcagtcaaagtaatcaagagcctctaacttatgagcatcagaaaacagcctaacggaaaatggttgtgtgaatgctacccgaacggacgggatggcaagcgtgtacgcaagcaatttgcgactaaaggcgaggccatagcattcgaaaaccacaccatggatgaggtgaacaaaaaaccgtggctgggggagaaagaagatcggcggcatttgtcagaagtgattgagcagtggcattcactttatgggcagacgctggcagaccccaaacgcctgttggcaaaactcagcattatttgtaatggtttgggcgatcccattgcctcagagttaaccgcaggcgattttacgaaataccgggaagcacggttaaaaggtgaagtaaaaaatgaagatggcgtgcttatgtcgccagttaagccccgtacggtaaaccttgaacaacgtaacctatcatctgtttttggcacactgaaaaagctgggccactggccagcacccaacccgctcgctgggctgccaacattcaaaatcgcagagggcgaactggcgttcctggcaccggaagaaattaaacgtctactggatgcctgtgctgattcgcagagtcccagtttgctgatgattgcaaaaatatgcctggcaactggcgcccgatggagtgaagccgaaaacctgcagggccatcagctatcaaaataccgcatcacttataccaagaccaaaggcaagaaaaaccgaaccgtgccaatatctcaggaactgtatgatgaactccctaaaaacagggggaagttattcacgccatgcagaaaatcctttgagcgtgcagtaaagcgagctggtatcgaactgccagaaggccagtgcactcacgtactgcgccatacattcgccagccattttatgatgaacggcggaaacatactggtactgcgcgatattctgggccatgccgatataaaaatgacgatggtttacgctcactttgcccctgaccacctcgaagatgccgtgacaaaaaacccgcttcacaacctcaattggaagcgctaatttatggcggcattttggcggcagggcattaaaaacgcgtaaaacggacaaatacttaataatactaactcgctgtttttaaacataaaacactgttttaactatactaaaaatggtatgcaggattcatgggaagcagggcgatgcggggcttaagttgcagacgtttgactgtaaactcaccttctgtttctgcaatgacgatgtcaccctgtagcggcttttcggctttatcgaccaccattagatcaccggaatgcagccccatatcccgcatcgaatcaccaatggcccgaacaaagaaagttgaactggggcgacgtatacaatacgcattcagatccagctcttcttctgtatagtcagttgctggagaaggaaaaccggcagcacatctctctgtaaacaaagggattgtcagtgcttcaggaatggatgctatgggaataaagtgcagcatgttatacctcaaaataactgtatgtatatacagtatgcaggtataagtttccacgttcaaatcgatgacaggatttttctgataagtggctgaagcaacgggaattaaagtttactccaaagtagtctttaatactgaacaatgcagagcccacagtactgatataagcgtacgcagataagttttagcgggggataaccggtctgagctaccagaacaccgacgtctcccacaagccctgcacagttaggcggcatactggtcgatatggccgcaaatgaggtcaaaaaagagaaagccaaagtggccttcttcttttccagtccgaccgcgaccgatcagaacctaatgcgggctgacaagttcacttactggcaataaaagtcgccagcattaccttctgaaatttcctcccgcatcacattttttctctcctgtgttttcattacaaaaaacagttgttattattcatgccgtaaatacctttcaactctcaccgaggctttgatgctggagaatgtaatcatcagataatcagttttctgttctgctcagaacggactgattatcgctgcgcttaaactttacgcgaacatctgcggatgttggctcgtttttgctcatgttgattaacaggttttccagtatgaatttatcccgtcaggaacagcgtaccttacatgtgctcgcaaaaggtggacgtattgtgcacgttcgcgatgcttctggtcgcgttacctctgttgaatgctacagccgcgaagggctgttgctcgccgactgtactctcgccgttttcaaaaagctcaaaaccaaaaaactgatcaagtccgtcaacggtcagccttaccgcatcaacaccaccgggctgaacaacgttcgctcacagcccgataaccgttaaggagagcattatggatatcagtactctcatttcttcctccggtcggctgcagctgtctgcagctgaaagtaaaataccctgggaagagctggcgtttagccagcgcatgctggaaaaccatctgtcgcaggatcatgactgggccagccgcagacagatcgtaattgaacagcaggttgggtggattgcccgtcagctactggttggtgcacgcattctggatatcggctgcggcccgggtttatacacccacttgctggcggagcgtggatattgctgtacgggcgttgatttttcaccggcatccatcgagtgggctcgtcagcaggcgcaaaccgccggtctgagcattgactacatccggcaggatattcgcacctactggccggagacacagttcgagttcatcatgatgacgtttggagagctaaatgttttcagtgccactgacgctcagacccttatcagccgctgtgcccggtggctggtaccaggcggcaggctgtttgttgaagttcatacttttgatgaagttaaacgtcagggtatggcgccggcgagctggcagcgttgtccgcacggactgttccttgcggcatctcatctgctgctgacggaaaacgcctgggatgaagaaacgcagaccagctcaacgcagttctgggcgatagatgaaaacggtcgcattagccgttttggcagtcagatgacggcctggcgcgatgacgaatatgccagtttgctcggtaacgcgggcttcaaaatactatcacacccggacagtagcgagtggccggtcagcgagacttttgagggcaagctctttgctctgctggcagaaaaatcaaaatccccggaagggcgttccctgaatacacagctaaaaaaaggagtaaattaatggatattccacgtatttttactatcagcgaaagcgaacaccgcattcataacccgttcacgccggaaaaatacgccacgctgggccgcgtgttgcgcatgaaaccaggcatgagcgttctcgatttgggcagcggctcgggtgagatgctttgcacctgggcacgcgattacggtattaccggtacaggcatcgatatgagcccactttttactgcgcaggccaagttacgagcagaagagctcggtgtcagtgaacgcgttcattttgtgcataatgacgcggcgggttacgtcgcggatgaacaatgtgatatcgcggcctgcgttggcgcaacttggattgcaggcggcgtcgcagggacgatgaaccttctggccatgagtctgaagccaggaggaattatgcttatcggtgaaccatactggcgtcaggtacctccgacggaagagattgctcaggcttgtggcgtctcatccgtggcagacttcctcaccctgcagggccttgtagcctcttttgacgagcggggctatgatctggtggaaatggttctggcagaccaggaaggctgggacagatacgaggcggcgaaatggctaaccatgcgtcgctggctggaggataaccctgatgatgattttgtacaggaagtccgaaaggagctgactgttgcgcccaaacgccatgtcaattacacacgtgaatacttaggctggggtgtctttgcgttaatggcacgctagcgaataaggatccccctggtagattaaagctgccggggggaatatgattcagggaggggcaatgttcaaaaacacgaattgggatagggccctaatataaatgtcaggaatgttttatgagatgcaaggctgacagaagctgaaaaatatataacagagtcaaaggcatggcagacagcctgtttgaggggactcgttgtgctactgatggtgacttgcaacttgcagactgatatctgggttaataccacattttcagctctgaagtacaaattttcatctaccgcaattaaatcgcttattaactatccctacgtataatgtttcgccaaatcccaccggaaagacgcagattttccggatcgctttgcaggatccgggtaacacactgcagataattctccttccaacgttcggtaaatgaaagctggctttcaaatttcagcggatcgaccatcctctcaagcacaaaatggatatgcctgtttttccatatcggaacactgaaaacggtaggcaaatgcattttccaggcaagacgagagcaaaatgtggagtaggtgatttgctgaccgaaaaagtcgatagtcggcgcactcaaattcagcgcgccgtctattgccaccacaagcgactgtccactatgtaaggtctgcatacaggccctgaccacgtccgcttcgcttttatcgctaaccgaaatcaatcgctcgccgtagctccctttgagcacgccaggagtggaagccacccatttgctgttcatctccagtaaggacaggatcatcggcccggcatacattgcgcccagatgagccgatacaataatgcagcctctctgatcgagttgtagccgttggaaaaactgttcgacatgcgatatgtcggccaatcggtacataggttcatcagcctgctctccccgacattcaagccagtcgaggagaaaattatcagcaagatagccccacttcgcccggcgttcccattcgtcgcgctcgataccggactgtctgccggcaacttcccatgcccagtcaaggcgctcaggcggtagattaacggcagatatttgcccatcaagcgccagcagcccctcttcgaatgattgaggcagatgacttgctctggcctgaatatagtgctcaaagacgctttccgtttcgcttgttttccccgcctgtaacaatgccgccgcggcataacggttccatttactcgtcacccctttttcccttgccagttgtacaaactcatcgctggcagcagtgtattgcccaacctggcgcagtgctcgggcatacattgctctgacataaggaagatcaggatgagtcgcgagcgactgctgcagtaacggaatggctttctcattctgatccgttctgattaaggcatcggcatacagggtcacgatacgtacattatcagagttaaattgcagggcatgacgccaatgctcagcggcctgaagcttcgcttcccgactgcgaccggattgatagtaagcaagccccaggctacgacgcagtgctgcaccatccaacccacgggctaatgcggattcccctgtctgaatggcttcctgatatttaccgacagcgcacagcgtatcaaccgccagccccgccgactcctgcctttctaacgcgaagaaagggagcaatgcgcgggccaggtcatgatcttctggtaggcggcttttatttaagaaactgaggcaggtcgcaatcatatctccccgtgggggaacttcctgcgcctgtgttctggccaacgagattgcctgtaactctttatccatcagtaccagtgtgcgcaaatggagggcaaaaatttggctatttcccgaaaaagcgagccatgcctgctcggctaagtcagcaacagtcgcatattgtttactcttaagcagcacgctcgcgaccagcaggacatcctccggctggcacacattcaccgccagcagtttattaactacctgtagtacagcgtccggttgagatgatgccagtggcgaaataacccagcgtcgtaataaatcacggccattctttgccgtcagcacacggtcagacaacaaagtcagcccgacatctgtttcatctttacgcaaacacgcgatagcgaagagaataatgttttgctcatttccagcactatctcgcactttttcgggatgctgactgaaatagaggcatagcccctcccaatcctcttgtttgagtagggtggttggcgatatttttttaaatgtagagtgcaagctcattatatttccttactcagccttattcacgcatccgcctgatggttatcaggagagaagtcaccaggtacgtgatgcccagcaacacgaagaacagtaaccactttgttccatcggcatagtgagtggtgtcagactcagccatcggttgagaaatgatcagcaaatactgtctctcacgtagagcttgaagcttcccttgctgtaaggtctgtaaggcagattcccagcgtgctttggcgatctcgctctgcaggcgaagatcttcaaataaggacaggctttctgaagagccttgcgaccctaacttatttgacaagcggttacgttgttcgccgatctgcttttccagtaccttgattttggccgacaggcgaggaataagggggttctgatccaaaccattcaccattaattgcgcgtattccgctttcgcctccgccaactgcgtttcaaagccagcaattaattgataaatagcggttatggtttccttcgggtcaatatctttttgtatatgctgtatttttagcaattcaagtcgagctgcccccagattctcttgggccgatttaacatcattttccagccacaaaatccgttccttctgcatccgcgctgaaacggtattaacgtgctgttcagcaaaagacagaatgcgctgggcaaaaaactcagcctgtttcgcactccgtgccttcacgtttaaacgcagcatgccctgttgaatatcgacagcaaccgagacttttgataaatagtaacgataaggatcatcattaatacccagcggcgcgtggaagcgggaaaataatgcgatatcgtcttgcgcgaaataagataaaaaaccgagctctttttccatccgatccatcatttctttcgaaagtataaactcgcgaacctgaaagccctccgacatcttattgcctgcaccaaagaaagatgttccagaaaaattatcctggctggcatcagtttgcacaataaaggtggcatccgcactataaaaatgcgatgttaaaatccacgacataagcataataaccagcagcggcaaagcaatataaagaaagagccgacgtagcgattgcttggcttgctgaacacgtcgctctttaataactaatgacgctctacggacagaatcagcatccgtcgcagaccacccggcgtctgggttatgatgactttttgcatcggccgatttttccgtctggcgaagggcgcgttcatcctctttttgttgtagccgcgaggctcggctttcttgtgctaccttcgctctttcttctttccattttttaatacgttctgaattttccacactctatccgtatatttactaattatatatcaaaggaataatcttcagtttgaatcgtcgcctgatttgactgatattgttcaaaaagcgcagttgcctgcgctaaatcttcacacattgtaatttttccatgcagcagtacgccaaacgcatgacagtgttctttaataagccgagggttgtgcgttagcacaatcaaccctttctgttgcagctgacaagctagcgccgcctgcatacgcaactgtgtggcattatccccggtgtacagcttgccatcagcaatataaaggcggcagggaagcagtaaattaatggcaaatgccagatgcgttttcatcgtgacagaatattcactcaccctgtcggtatagcactgttcaagctgggtcaattgataacagaaatgtgaaaactcatcgccatccaggccatatagacttgccatcattcgcgcattctcctcaccggttaaccctggcagaataaaagagtttgcccccagtgggagcgcatcaccccgtagcccaataaaatccccctcatcaggagcatccaggccacacagcaacctggttagcgtcgttttgcctgaaccaggagccgccagaataccgatatgctcatggtagcccatgacaaaatctgttttatcaaggaccacccgcgggcccttatcagactcaaaatagcgtgtacaacctaataaaccgaacacgaatgcgtctctcctgaagctaaagtcagtgattttcagtgtcacaaatcaggtgaaaaatgaggcccgcgaggaataacgttgcggaaaatgccagagggtaaaaaggttcaaggtacaaggagtgatacccctcaaacataccttctctgactatctcattagcatgtagtagagggttccagctgaatatgcttaataatgaataaggcaattcattcgccgtataaaagacagccgaaatcaaaaacatcggtcttagcatcacaggaacagctttgtagaccagcggaaaccgttcagacagtgcgtcacaaaagtaaccaaacgataaccccagaagccatgcgataaccatcccttcaaaaatcaggaacggtttttgggcctcccaacgggagaatataagaaagttaattaatgaaataataatataaatgataactgcattaacaaattcgattgcggcaagagaaaaaatcacatgtcttttcttaacctgcgagacaaccgctaacgatgtagagaatgaatgggttcgcatggttgcggtaatggtataacgaaataacagatacggtaatatccctgcaataacaaaactgatatcgtcagtggatattggcaccgagcgatttaaatattgaaaagaaataacggtaatggatatccataccagtggtacggccagcaccatcatatagtttagtaaattaccgttatagcgtgttttgatatcgcgtgacatcaataaaataattaactcacagacggtaatgagtttcataaaataataagaattatttttcaaaatattcatatggcgacattagaaagaattagtgccgcgggtcaaaaagctatcgaatgcggctttcaccttagcgaaatcagtcaaagaggcgttcgagatatagataacatcgccgttgtccactcgtatggcctgcgctaaaaacaccgagttaggttggctcatatcgacatgatagatattcagcttacgcatctgctgtttcgcctgttccgcttcgttatgcttgtacagaaaaatcgcttgcggatcggcaagattgtcatttaatcctttcgcgagcgccaaagcatccacgacgctggaatgacgctgaaccagagcatgtttcccctgaacacctgctgcgccgagcacattaacatactcggtcacttgacgcagagtgatacggtcatccggctgtaaggcaatatccaatccgggatactgataaatatctgacagtcgcgcagtgaaataatgctgctggcgcgtcacgtgaacttccatcatatctgtgctggtattttctactgccactgccgttgccaaaagatgactcagacgattcatactctgttcgagagggtatcgacccgttttcccgctgccctcgaccgtcaccatggctccggtgcgggcggtaagtgtcacaatcacctgaggattcaggacaacgcgcgaaagtcgctttttgatctcatcagccagttgcgtcacatccaatccagaaaccgggattgtcccggcataaggcacctgaacggtattactgtcagtcacaagaatattttcaaaatccgcacggtcgccgctcgcgttattggataaatatccagccccgcccgaggataaaatagtgatatgcagcacatcgcctttagccaaagatgtccagtgccagttatttgcggcaaaaaccggatcgacaatagttttcggcacagtatcgggagcgcttagttttaatgtcggcgtgacttcgaccagattataacgaggatcgtcctgattaataaggctggatttaaataccgccctgggaatagtgcatcccgaaagcaggaaaaatgtcgttagtaatatgatgatttttttcataacttattttataaatgaaatagctgaaaaatgatgcccattaaatgcatatatgaatatcctccttagttcctattccgaagttcctattctctagaaagtataggaacttcgaagcagctccagcctacaccccgggctcgaggtttaaactactaggattagtgtttcttgtcattcatcacaatatagtgtggtgaacgtgcacgcgggtgcaggaagaagtgaccttttggtgcgttctgactgttgattggctccagagtgacgccggtattcgctttgcctttacgatcatgaacagcatagagaataaagggcagggcaagtaccaccaggaaactaacaaccagtaattcaacatacatatcggtagaatcaccctggatgttatccggcggcaggaaggaaacaataaacgccataattgaagtcagcagaccgacaattgccacgaccagtttcacccctttaccaccagggatattaaatgtgcgttttaagtcaggatgtttaagaaccaacacaatgtagccaataaacagcatgaaataagcacacagataaatcaccaccgtcagcgccagtgcgatcaggaaggacatgttgttaccgccaccggtattggtgaggatgatcaacgcgatagaagtaatcaccagctgcgaaatgaccagcgttaccggtacgccatttttgttcattttagcgaatgccgctggcagcaggtttttctgcgctgtgacatacatcccgcgagaaggaccaacaatccaggaggcgatttccgccagaacacccagcaacagcagtgcggagatcacgcgaaccgtccactcaatttccggtgccacatgggacatcagaacggtaaaggtttgcattacccctgcggagaggttgatttcattacccggaatgaccatcgcaatagacaaaccgccaacagagcttaagcagattgccgccaccatcagcagtaacatagccagtggatagtcgcgcccggggttgctcatttcattgacgtgagttgcggaagcttctacgcccatataactcaaaatgaaggcaacaaatacaaccagtgtgcccactttagagaagtcagggaagaaggtcttcgaatccatttcgatagcaacgggggcaccggagtgcaggtaaatagccgctaatgcgatcaaaataaatgcaggtaacaggataccggcgaagaagccaactttagcaattcgcgccgtgtatttcgtgccaccaaactgcgttaatgccagcgcccaaagaatgatgagtgctgcaatagttttggtaatggggtcttcattcagcgctggccatttcaggatgtaggagagtgcccctaacacgaaatagagcatcggaataaaaccaatggcgatttgcagatagccaaatgagatcgctgcaaatccccatctcggacccagagtatttgatacccaggcgaagacaccaccttcttcccagccgtcgacggtggccatttccgcagcacaaagtcccacgggaataaaccataaaatcccgcctaatagcaggaagaagactaatgaaaagcccgatgttgcgaaggtagggtattcataaacagccattaccatcgatgccgttatggcaaagaatccgagtaatgtgagctgcttagctttacctgtctgtactgatgtagccatattatcactccaaaacggttatcaggtatgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgaccggtacagatgaactcatacggccccagtttggcgatctcatccgccagataggcagcgacctggtaggaagcattctgtactttggtatagccttcacgaccaaggcgcaggaattcatagtactgtgcaatcacctgacccgccgggcgggagaagttgatggcaaaagtaccaatctgaccaccgaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccagaaagccaccgctggcggcgtcgatgtgcatgtcgatgtcgataccggtgtcggcctggaatttatccagtgcatcgtgcagcggttgcgggaactcatagttaccggtgtaggtcacgccgaaagtcggcaccacgccgatggtattttcgtcgcaggcttcaatcatgcgtttcgggtccataaacaactgaccggggcgcatagggatctcacgcagctccacatcccagtagcgggcgaatttatgccagcagatttgcaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatgtttacgcaacgcaggtcgatggctgcggattgcggatattcttctttgtcgatccagtttttgttaatggataaatccatcaacttgtggacgttttcgtcgtcccaggtctggcagaaagtggccaggttctgacgagcgttgccatcaagatataattcatcattgataatctgaaatgcgacatcgtcgcgcatttcgtgcagcggaaaacgttttgattctgcgatagtggaaatagacttcgcaccaaaacgtgaatcgagtagttccgaccttaaatccgttacttgcttcttatccattttaaactccttaaaatgattggatcgcattaaaacactccatggtcagcccttaaacacgttatagccgagttgcttagcgaccgatgccaccattttttgaccgcgaacactgttgccttcttcgtccagcggtggtgagaacgcggcaattcccatcacgccagggacgaccgccagaataccgccacctacaccgcttttgcccggtaaaccaacgcgatacgcccagtcaccggagcgaccatacagcccttccatcatcatttcggccagaatgtacggcacgttgtcggcctgaagaacgcgtttatgcgtcaacggattcacaccacccgccgccagcgtcgcgccaagcgttgccagttcaacagtattgatgagcgtagagcactgacgggtgtacacgtcacaggcttccattgcatcacaatagagatatccggcggagtacagcagccaggcaatggcccggttatggaagttggttgtttgttccgactggttgacttcgtcagagagcgctacctgctcaccagccagttgctgttggatatgtaaaattcgctgccagcgttgttcaacattttcagcgttaatcaggctggtggtggcaatagcgccagcatttaccagtggcgacagcggtttgccgccatgcaactctaaggcgataactgagttaaagggcaatccggtcgggtcagcgccaattttgtcctgtaccgcctgcgggccgacatcttctaacgcaagggctaacgtacagactttagagatggattccagtgcaaagcggtaatcactgtcacccgcactatagacgttgccatcgcaggtcacgatagccactgccgccagttgacctggtacattcgccagaaagggaatgtaatcggcattttgtccgccgttaagtgagtgaaattgggtgtaagcctgatccactgcctgctgtaatttgtttgcatctaacatcttttgttaactccgagctcgaattcccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggtttggttagcgagaagagccagtaaaagacgcagtgacggcaatgtctgatgcaatatggacaattggtttcttctctgaatggcgggagtatgaaaagtatggctgaagcgcaaaatgatcccctgctgccgggatactcgtttaatgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtttgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacggggttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgtatcagccaggcgaagctgcttttgagcaccacccggatgcctatcgccaccgtcggtcgcaatgttggttttgacgatcaactctacttctcgcgggtatttaaaaaatgcaccggggccagcccgagcgagttccgtgccggttgtgaagaaaaagtgaatgatgtagccgtcaagttgtcataataaatcgaagcagctccagcctacaccccgggtacgacttccctgatgtatttttttgtaatgcggttatgcaggtcgagatctgccttgtcaccggctccgttggtccattcactttctccagtcgctgccaatactgcaaagcctgcgtgtagtcgcgtaaatgcattgcatttaatgcggcatatttcaaggcataggcattttcgctatcaaaaacgagtaattttttcgcatagtctagatgttcataagacgtgatagtgctaccgccatccttccgtgactcattaaataatctgataatttgcttatattcacgcatcagacgagaaacatcaggctcaattcgtttcaggctaatcaatacagacaatgcttcatccagacgcccttcagttttcttctggcgtacatatttaagggctctggttgcaacattgcgacactctttctcaaacaacttgttcattgaggcattctggaatgatagagtaatgctcatgacgttagcaatcaaatcaatgaggaacggaatgttgttaatatgacgtatgctgcgtaacataatcgactgcaggctggtaatgttcgagttacgaatcaaggtcatgtgggccaacgtgcacgcgtctttccaggcaccaagattcaccagcgttcttgcacaatatacggtgccaacgggatcaaacttcagaagtggccacactattttcgcccctgccaggatattttcataatcctcacgctcatacatttctcttaatttatcgcgccatgccattttaacttcattattaaagcgagaaatacgtgaatggggataaaccataaatgcagagtagctataggctagcgaagtactcagtgagacaaaatcatcaaccgaatgtagcgacagcgcggtattgttccatgcctcaaaaacgtcgtggattttatctttatacgaggtgcgaagcgcttgatgatagctcatattcttgatgcagaaagctgtgcggataacgagaccggtatcatgaatcgtcgacaataccgtcagcgcaaattctgactcatggcggagtagctgctcgagcgcatgcatgaaaatcaattcatcactgaatttgattgccaaagataacgccgtttccataaacgtatcatttaggcgctgcgattgaatgccggcatggaaagcttcagagaatgcgttgccatcattgaaatattgcgtgctgctcaggaaattaacccatccgctttgagtttcaggattcaataatagtacacgtttccaataatgatatgacttatcaaacagctgtaaagcatcggctgagccggcggcaacggtaaggacttcttcatcttcaatttcattggaaagcatcatctctgccgtcgataaggcttcccgccaacgcgctaatccatgtagagacctcagccgacaacgtaatgtactgtcagtcgtaccgataattttctcaacatcactaatatcctgataagcctgttcataataacctaaatggctgaagattacggaccgaagttggattagaacgggatcttgctgctgatttcttaatgcggcaaaaagttgttgtgatgcagcaataatgtcgccatctgcaagctgcttagtgatcgataaggtaatctcacgtatttggtcctgtttctcttgtcgcccctcatcaagatgatgattagtattattgatcactcccttaaaaatagccgcaacgatcgcgtcaccaaacatatcggtataatgagtaagatcgtcgccatttttttccagggctcgtttctgcccccacttttccatcaaatttgtcgggttaacgcagggaatatccatcctggcggcgatggtgtcgacatttttaatcaaccgactacgggatagaatgacggttccagcacgagtcacggcatcaacatgtgtcataaacataacgcgatcgcgaccaagaagctgaacgatttccatcatatcctgttcgatagcatgctcatccatctgctcgacattgatattgcttaataaggcacgatcgtcttccgacattccggcaaaacagggatcgtctttgagataggccagcagtttgtgtcgatttccttgcgtggccaacgaccagtacatgcacgcccgctctgtttggctaaaaaattcatagaaatgacgagttaaataatttatttgtaagcagaacccataggccataatcttcttctgacttgaaatctcaatgatatagaaatcagaacgactatgtacgtcggtgtttgaatagtttacattaggtctaaaaataaatggtcggaccttttcaggaatgtctatcaagcccaaaataaaccgaatctgctgtaatgcctcgctgctcgtatgcgtaaaaccatatattctcttaaagtttgcctgaaaattaaaataaggctgagctcgttttaccggactcacaatacggcaactgccaatggctgtaagcgtaaacatccctgacgatttcattaaattcatccacgtgaaaggaaagtgagtagttataccgaggaatacaaagtagaatgtttatcgatataccattttagagtttgcttaagtccttctttgatatcaaattcaggctcatatgaaagaaatgtttttattttggtaatatctgcctggctatgcttaacgtcaccgtcacgaaaatctttataaattggttcagctctactttgttcgttccgccataaattaagcccatcgcgaattagataataaagctcatttaacgaagttctatctccaactgccacattatagaccttatttttagaggctaaatcattagttgttgctgataatagattggcctgaatcacattctctatatagcaaaaatccctgcttgttgagccatcgccattgatataaattggttcatctttaagaagcgatagtatccagcgaggaataactgccgagtacgctccgttaggattttggcggcgaccaaagacattaaagtagcgtaggccaatagcgttaaattcatagctacgtgcaaacacatcagcgtacaattcattgacgtattttgttaccgcatacgggctgagtggtcgaccgatccgttcctcaattttaggtaaatcgggatggtctccataggtgctactgcttgcggcgtaggtgaaactagagacatgagcatctctcgccgccgtcaacatatttaaaaaaccatcaatattggcgctattagtcgcgatgggatcctttagggaacgtggcacgcttcctagcgcggcttggtggagaacatagtcaacgttcttacacgctttctgacagtcagtaaatttcctgatgtcaccctgaataaaaataaatcgcgaccattgctcctcactgacggacgtgcgaacgtcgtctagattatgctgataaccggtggaaaagttatccagtccaatgacagtctggttgagaaagagtaattcttctaataagccggagccaataaagcctgctacgccagtgatcagccagcgctttggtgccagaaccagtttggtccgtagttcttcgtaagccgtcatgattacaatctcacatctgactgctcagccggaagaacatacttcaaatcataaagtacatgtttatcttttccgaagccgcgaatatcctcacttcccatctgtttaaattgctgatgtcctactgcaacaatgatcgcatcgtagtggcttgatttgacttccgataccgggataatgccatactctcgtcttacctcttcggcatccacccatggatcaaaaatatccactttacaactatatttaccgagttcctttaccacatcaataatgcgtgtatttctgatgtccggacagttttctttaaaggtaaagccgagaatcagcacgctggaaccctcaacgttaattccttttttgatcattgctttgatcaactgctcggagacatagttgcccatgttgtcgttcaggcggcgtcctgcaagtatgatttctggataatagccaatgccctgagatttatgtgtcagataatagggatctacgccaatacagtgaccaccgaccagtcccggacggaatggcaggaaattccatttgctgccagcggcacgtagcacggcttcagtatcgatatttaaacgattaaaaataatcgccagctcattgaccaaggcaatattcagatcgcgttgcgtattttcaatcaccttcgctgcctcagcaactttgatgctctctgctttatatgtacctgcgctgatgatctgctgatatacttcatcgataagttcggcgatctgtgcggttgaaccggaggtgattttcttgatgttggttaaacggtgctttttatcaccgggattgatcctttccgggctataaccgacatagaaatcctggttgaaagtcattccggacatacgagcaaggatcggcacgcattcttcttcggtacatcccggatataccgtagattcatataccacaatatctccccgattcagcactgtaccaacggtttcactcgccttgattagtggggtgaggtctggttgcttgtaggtatttatcggcgtcgggacggtgatgatgtaaaaattacattctttgatcttctcaatctcggaagtaaatttcagataacgagcctcacgtaattcttcttcagtggtttccagattgacatccaccccattctttaattcaagaatacgctttttattaacgtcgaagccaacaacctgacgagatttgccaaattcaactgccagaggaagcccaacatatcccagcccaataatcgcgatttttacctcgtctataccgaacactcttattaatcctttactaaaattttatatttacaaagttaattctaggtgtttattcagatacgctaccgcccctggccgtagcagccagtatggttaatgaaaacgtataaccgtacccctttcttacttgaatagaacagaagtcgctgagaatatatgtattaacgccaatgagtaacgaaaataattttgtgctgaaacgaaatacttgtccgtgttttactcaataaaaattaccgcattacagtaaagtaactgaatccggcaataacagatagcgcggctcacgtactccaaattttactgccaattcttttctccagcgatacatagtcgatgatgagttcataaatctatcctgaagctcttccataccactttccgaaaggaaatatttcatctttactatatccttacggttaattctgaaacgataatctctctgctccgtcaagatcttttcaccactttggtgttgactgacatttctgataatatcctggactgatgttgccgcatcgaaaacagcaataacatttttgcactctgtcaaccaaaaacgtgcaaggggcattagtcgcgaacttgaaatgataacgattattttattaatatcactcattcgcgtgaaaaaattcagggcatttaacaggctgtagcgatttaggttcacaaacaaataatttctgtcatttgttatcagtgacacttcttcaataatgccagcagctccaaccccgaaatagatatcattcggaggccagaaatgatgaaacctcatgaagtctccttatgctgaaataacctaatttcatccatagaaaaggtacaagcaatatctaattctttgctcctgttaacaattaactaacaataaaattattaccctaattttaatagtactaacggcctaaacgggatttttacacaacagagaattgatgtcaaacctgcacaattcattgtttgtacctatcaaaaaatcttatttagtctagaaaatcgaatgataaattatgctaaattgtttggatagggcgtattttttaatcctggcgaccataaaaaatgctaagccattcctcaaaataagaatattcctaatcgtatttgaaataatctgttacaaatttaattgtttgcacctttggggttaaaccttaactgtacagaatcacaggctgtattttaattactctttgccctgtttccatttcaaattaaagatatggataatgactattgttagttaacttttccgttgacgatgtctacaaaatattttctcgctagatgtttgcattagagtcacccattaataatgaccggaaaaccgtcagaacgtcatactggttttataatttccggtgaaatgatggtgcgtgactgcttcggaaatgaataccttattcatgccggcgaagcatttgaggtttctgagaatcatgatgcctgggtagtgggtgatactccgtgtgttgcgctggatttcacgcatttcctccgctgaggatatgaacttgatggtacagggctggtttgcagaattcttttttttggatttataaattgcactggataacagtctggcgggttctcaggatgagcaaaatgcttttatccggagcccgattatgccccacactgatactcctgaacaggctgctgtcatcgcatggaagggcgaacgtctggttgtctgtgcttttgccgggagtggcaaaaccaccacacttcgtcgttatgctgaggaaaatccaacggaacgaatgctctatattgcttataaccgtgccattcgggatgaggcggagcagaaattccccttcaacgttacctgcaaaacatcgcatcaactggcctggccgacggtcgggaaacattacagtcatcgtctgattaattcactacgactgacctatgtcgcccgggcgctaaactcccgcaactggttgctggccagactgacgcttgatgttctgaatcgctttatatgcagcgcggccaccgatattacgcctgaacacatgcctgatcctgacgactgtaaggggctacaaccaggtcaaatcctgttttcagcaaagaaaatctgggcaatgatgtcggcccgtcagggggattttccggtcacccatgatacttatctaaagctttaccagttgagcaaaccgaatctttcttcccgctataccacgttattgtttgatgaagctcaggatgccaatcctgttatcagcgccattgtgctcaaccagacctgccgggtagttctggttggagatactcatcagcaaatctaccgctttcgtggggcggataatgccatgcaggctccgcaactggagaactcagaccgtctttggctaacccacagctttcgcttcggtccggaggtagccggggtggccaacaggctgctggccctgaagggcgaaacgcatcagataactggaaaggggggcgcaggccgtgttctgctcacaatgccgcggaattttggccatcatgctgttcttcaccgatctgtctgtggtgtcatccggacggcactgcactggtcgctggctggcaggaaagtattctgggttggtggtatggaaagctacagaattgaggatttactggatctgtactggttctcaattgatatgtcggagcgtatgcgacacgacaggctgacccgtgaataccgggactatgatgaatatctgcagatagccgaagataccggtgatgtggagatgaagcaggggatatttattcttgaacagttttttccgttaccggacagactgaatacgttacgtgagcaacgcgtcatcagtgaatctgaagctgatgtgacggtatgtacagcacacaggagtaaggggctcgaatgggacagggtgaagttacatgatgactttctcgatattctggatcctgacatgccggaaagtcagcggcaggatgaaattaacctcatgtatgtggcagccacccgggcgcgtaaagtgcttataaccgatccgatattgcacgagcttctgattcagccccgggctgaagatatagccggaacttctgcggataaatcgggtgagtcagaagtgagtacagaaaacgataaaaaagggactgaatatgttccggaaagttaagtcatggatggagaagaaaaacttcagacagatagaagaaaataaatcgggaaatgcgaagaagagacttattccctgtacggatggatattttaaccctgcggccatttcagatttgttacagcatgaacgacggcagcaatggttaaggattttgtgggagaacagcgcgctacctaaagagcgttttgaacgttattttttactccctttacacggcgttgtgggtttatgtcagagactcccggcttcggctcagggaaaatttgcctatacagacggcatggtggattacgtcatacagacgacggtctttgccgtacgtttatcaaaaggatatatgctgccccgaggtgcatctgcagaggaacaatccgcgcagtcagtcagctggagtgctgtcgtttattacgctgcattattccactcgttggggcgcttatggaatattgaaggcgagctccgtagtggtgctgtatggcgcccgggattaagtgttccggaagaaccttatcgttttcgttttaaagcagaacccgatatagcaggtgctcaggtttatggtgaattgatcgctctcagatttttgccagaaccggttcttcagtggctgggtaaaaaccctgatattctgagaacattgctggctttcataagcggacgttacagtgatgcaatggatattacggatatcgttaatgaggccattgtgcatgccggagggatacctcttggttttcccattgcacaggaagagcagacttctgaattagcagagatactaaaccctgccgcgacagtagctcccgtgttgaggaaaggttcttctacaactcctcctgatgtccctgtcatggttgatggagggcaggagactactgtccttttatcttcccttgattctgatgctaagcctgaacgtggggaagggcagcttactgctgaaacagatccagatgttcttcaggtcatgtcgattctgggagggctgacgaacactgacacacagtcgcctgaaaaggaaggcgtgaacacagagaccgatatggtggcaggagaatcgtttccggaagtcgcggttgcacttgagacttcagcagcagaagaggttatcaatgacaccgttaccactgaatgcactggatcatcctcgggtggcatatcatcgctttcctcaacggagctgggagatttgttctggtcctggctaagggatgggcttcgtgagggggatataccagtaaatactgctgatgcctgtgttcatctgacttgtggcttcgtatttatcagcgtcccgggtgttttttttctgtttttgaaatcacattcgcgttcctgttcttctggtctgaaagaaagcgggaggaaggagcaggtgcaggcggcatttgagaagatgcgaaagcatcgggtcagtgattcccggcgattctggcagtgctgtctttatgaagagccagggggcagggggagatacaaaaagttaacagggtatctgataaaaatgtcagagatttatgctaatggtaactttcccgacgacagtttatttctaaaggtcatcaattgaaataaaatgtaacaaaataaatataagaaaagtcttaaaaaaccatcagttcctgtaacaaattgaaatatttttccgttgtcatgtgcatgaaattacgggaatttaaatccacacaagctgtgtgtgtattaataataaaagctcaatagcggtgataaaaatggaaacaaatattacctggcaacaattgatagatgaatatttcttcgcaaaacctctgcgctcagcatctgaatggagttacaccaaagtcttcaaatcatttgtacattatatggggccgttaagctgccctaatgatgtgacatatcacaaagtgcttgcctggcgccgttttcttttaaaagagaaaaagctgtccggacgtacctggaataacaaggtggcgcatatgcgggccatctttaactacggaatacagcgagggttactgcactatgacgaaaatccgtttaacaattcggtagttaaaccggacaagaagagaaagaaaacgctcactcaggcacagattgagtatgcctatcagatcatggagcagtatgaaaatcaggagaatacagggctgggactgaaatattcccgctgcgccttatttcctgcatggttctggctcactgtcctggatacgctctattacacagggatacgtcagaaccagttattacatattcggctgaatgatgttgatttgagagaagggcagattcggctgattacggaggggtgtaaaaatcacaaagaacactatgtgccggtgatcagttttctgcgtccacggctgacctgtttaatggagaaagcgcagagcgaaggattgaaaggtaatgaccgcctgttcaatattgcactttttaccggcaaagatcccgccattggcgatgacatggattctcctcaggtaagagcattcttccgtcgtctgtccaaggagtgtcagtttgcgatcagtcctcatcgtttcagacacacgctggccacggagatgatgaaaatgccggaacagaatctgcatatggcgcaaagtgtgctgggtcattcaaacatgaaatccacgctggagtatgtggagaatgatattgcagtgatggggagggctctggaagcgcagtttatgcagattaaggcagcacatgcccgaagcatttacagtgggttgacaaagaatagataagctgtaacgatatcgggtgatcgagaaaagggaacttgcgccaacaagttcccttacttgagaaacccaaaaatccatctcgatgtgtagactgacctgctacatcgattgtcctttcgggttccacgtaacgtccgttaaggttctcaagccctaaccaacgtactttgataagagtggtgcccggactcgggagcattcagctatctattaaattgaattccgtcataaatccgtttttgacgaattgtcaagaccctgagcgtgacccgtatttttacttgtaaatcaaaatagtggcttttgaggtataaaaacttgttcggttcgatgcactggttcgattccctttaaatctatcgtaatgacatctgcgttacgcgtgttgtatacttaatatccacagaaacacaagaggacaacaccatgccagtcgcaaacagtatggcgatgaaacgcgaaaccctgaacctgcgcatcaagcccgccgagcgcgatcttatcgatcgggctgcaaaagccagagggaaaaactgcacagactttgtgctagaagctgcccgcgccgccgccgaggaagcgctgatcgagcaacgcatcattatggccgatccagaggcttatcaggcatttctgatccgtctggatcaggctcctgcgccaaacgatgcgttgcgtaaaaccatgcagactcctgcaccgtgggagcaggaaaaatgatctccgcccctgaaccgcttcatgccgggcatattcttacccccttctgctgcggtgtggattcaatggataactggctaaaacagcgggcgatgaaaaatcaggtaactggcgcatcccgtacctttgtgtgttgcggcagcgattctgacgtactggcgtattattcgctggcgtccagcgcggtaacgacaaacaccgcccccggtcgctttcgtcgcaatatgcccgatccgatcccggttgtggtgctgggccgtctggcggtggatcggtcgctacatgggcagggcgtaggtcgggcgctggtgagggatgccgggctgcgggtgattcaggtggcggaaactatcggtattcgcgggatgctggtccatgccctgtcggatgaagcgcgggagttttacctgcgggtggggtttgagccgtcgccgatggatccgatgatgttgatggtgacgttgggggatttggttcatgcctgattggtattatttggtgccaataagatggttgttttatgaatcaaattatcaatgatatattgttgctcggcatgtccgctgtctgaagtcatcaggtatcttcagtgtttaatgtgaagtaaaataagatctgcgcacaacctcaaacattattttaatgcttgaggtttgattacaattcaaaagttaaaaattaacttcatccggggaaaaagattagaaaaaaagaccaagaaactaatagaatagaaaatataacacacaataaatattggtgaggtttttaaaactggcttaattgcttttctatatttttcaactaatcccagatcatatagcctggctttcctggagtctcctattaagttactatcaatatcctttgctatgtcttcttctattttatgaaacgctcttttttctgtcatgtcctgtttggaattaaatataaatatgcagaataacaagattgccgcgataacttgaattagtggtatatttacgctccaacatccaagagttgaaataaataaccaaatcccttgtgagtttgcctgagatctaaattcatcaatatgtttactataattcttgatatgttctaatatagcgtcatttttacattgttccatacaattatttccattgtagacatttaaaatcatcagaagaaaagcagctacatgtagctgcctatagatataaagacgctgtcatttccgccctttattggcttgggaaagaactgaagcagcaagcgtctttgtttggtcattatatttagggctatttaaaacttttgaggctgtagtctccatttccccacccgtttggtttgaagtcccagattgggataaagcagatccggctaaacttttctgaatagctgaagcattaggatctttcagcacttgagctgcttgtgatgcaatcgttgaggaggttttcttagtattatttggcatatgtattagcacctatgtagagttacagttttgagcatgtagtatcattttttaataaaacatgccatatgttgtatatactgtattcatatacagttatgagatcaagccaaataatttgatatatatcaaatcatggttatattatgtttaaaacataagagctacaaagcaaacaaaataaaggaatccagttttccagatggccaatggtattcacttggtggcatggtaatacttacggtgttttgttggctctcgctaattaacccgatctctggttaattagcgagagctatattgctaacgttggtggccaccgttccgtgaaacatctaaaacgaaaacatcaattaaatcacggagatcagccggtagtactgcttcaatactaatttttagctcctgagcggttttaattccgtgggttttgcggccagcaacggtttcgctttctccaaaccatatgacaagaaagataccttgctgttcggcatcagggtgaatggaataacggtcatagagttgggctgaagcagcagaatataactctctgtgccactggcctttgacttccgtaaccagcagccgtcttcttcctccaatcaatttagatgctgtgaaatcactcctgttttgccctttcaactgatgctctggagttatagcgataccctgaggctgaagtcttaaactcaggcgctccgcaataatctctgtggactttacctcatcgaggcgttcatttttctcatagaagcgatcagccgagttaaattccccgccatcaatcgctttctgaaaatcatgaagctcctgaagaactaactgacgcaggccttcaacggtaacgactgaatcacaatcaaggcgttgaactatctcatctggcgtcggtggttcaaaatctctgagtgctttttttctgatctgatcagcgtatatgctttgcaactctttatgtagattggtgaaacgtggatcgttaagaagacggtccagcactggtattgcatcatcggaagtgtccgagtttattgaccaaatcaaatcagtcaaaaagcggtaggctttctcttctttagggctatcactaccccagctatcaggtagatcaactcgcggccagtgttcaatgaaagcgtctaaaatggcttcaactttaattgaggcgagttccggccaggcacggtgctcgcttcgattcatacgtccagaacgttcataaaaatgcagtaaattatttttatcagattttaaccatgcccaataagtatccgcaatgttctccataaagtagaattcacgtaccagccagaatattcgtttgcgttcaatatcctcattttctttcggattgggccagcctgacatcatctctgagcaacgctctgcaataatctcttttaaattctcacgatcgccgtattgagcggcaatttcaaaaagtgtatcgactgaattaagggatacatcgggaaaacgacgaagccattcaatggaaagtttagcgcgtgaatgacgaaagacctcttgtctacttaataccccgatttcagggtgagggcatggctgagtgagttggggttcaacgtactgtcggagatatttttcagcactttcactataaggaaaaatgaggcggtcgatttcagtctgtagcgcatcacgttcttctttcgaaactgagtggtatcccctgtgaatgttcgttcttaaggctgtaagcaactcgatattgacgcattcaagattgccttctgcacgtagaatctccagacaggcggcatataaaaccgtctcagaatgcctgtatttagattcgcattgcagtgctgctagttcgggtagagtgggaacctcgggagtaataaaatccagacaatttcgcaacgctgtccgaaccagtttctcgtcaccaaattctaattcaattctttccggatgcatgagcacaagttctgcaaaacgcagcaggcaccgccagtgacgacctcgctctacaatatctctgttctcattaacaaattttatgtttctggcgtggatctctcgttgctttctgtcacggcgtttcatttttcggctatgtctgaatctccggagttggcttttctgcccggataatttcattgcattgttgtatcgggcccattcacgcataaatgcgggcttggagagggcatgccgacgcatttgtgcccgcaaatcatcagggccttgctcttccttgtttctgtaacgttggtggttgacaaggaaactcgcccacaggtcaacgttatctgcttcaaaagccagattgaggataaatttatagtcattcctccataaatgaaggcctgaatgtgagtgcagatgcccgtcgaacttttctactcttgtgttgaatatttcattacgatccgttaaaggcccaaatacataggcaatgatcccctgacgaagtgtgtcattttcccgaagcacttgtaccgatttgctttgatcggcctgacattggtgatgaaaattgagattacctatccattgccagatcctcacaggatcaaatggtgcttgagccagttcaaaatagcgatcgaccattgaaccgacaatcttgcttattccattacgacaatcacattcataggattctttcccacaatggcaataaaggttacaggttaattcgtccagaagaagttcgagagtatgcagtgaaaaacaggaaatgagctttttaataaaataacgaggccgaccactctttcgaattgttcttcgtgaccgggatagagattcgcacagacgcggaagaatccagagagatatcggtggtcgaatttttcgggccctgtgacttcgatgacgttggctgcaatattgagtgaaatattactggcctcaaaaatcaaaacagctaaagcgccaatgcaatcgtattctttgatattgagtaagcatctgcttgctagggttcgaatatgttcagactcattgggatttaacgtaagctggctcaattcaggcaccaactgactgtttactggagagtctgccagaagttctaaaattaaatcacgtaaatgaccatcattgcccatcgttaaaagaggctttatttcctcaacaacgtcttgcgtgaaaaaaccagccgcgctgaaccggcgccagaaatcactccgacgaaagtaaggatctgcggcttcaatctctttgagttgatagagaagctgtcgttttgatgagcgttcaagctgcgatggatcgccgtttgcgagtaccgcataggcgtcaagctcaataatggatccctgtaccgacctgttgcctaatgctgccatccatccgagcagacctctcaactcatctctggcaataccgttcggtgcaataacaggcaagcactttggtaaagtgaggacatccacaggatcggctattcgtttaatgagataatccgctgcgcagtattcagcgacaatcttgtggaccgggcggtgctggtcttccttatcgccgggcttgaaaagctgagttgacaatatgtcgtaacaggccgcactgctgctaaacaacgctggcagcatgggatacatccggtttgccgtcacgtcgatggtgctgactccctctgcgcccgacaacagaagtttggcataaacctcggcagaaaatgaaatcttctgtgcaactgaaagagatacaggggctttcgggatatctggattgacttccttagccagtcgttcgactgctaaagcaaagattgaacgtttgtcagcaaatcgcctgccactttctaaataggcatcggtgaacattttcagaaactgagggtttggtaacaacatgtctaaactaaaccgtgttacttcggtctggaatgcaaagaagtcttcttctggcgcatggtgcttaaagatagcgtgttgctcgtcttgatcgaattctttcagcctcacaaccatcggggagaaaccaagaaatttttcaaaaatgctggtacaagcctgtccccattcgcttgatctacttgacatgattacgcgagtcggctttgatgttctggcgagagcaaggagtttatgaatacctgattgatcaattctggcgacttcatcaacggcatcaattaccagtgcgctattttctttatctgctcctgcgtaagcaaatacgctggcatttaagacagtagtgttcagtttccgagcgaggcttttcatcagttccgttttcccgccgccgggttctgctaacacaacaacgtgcgttgatgccgccagcaactctgtctctgtgtaggttctgtcaccgtgcgtaaaatgacgttcaagatagaagattgaattcatcgttacaaaatttttcgtattgaatagcccaaatattccagcagaaaggaaagctgcgcctgagttttcttgcttatatcagagatagtacggcatttattctttgttggtgggatgttttatcaactgttgtacacattatacaacttattgacattaatcacatttcgccacagcgatgtgcgggctaacagataataaacctttcctgttatggcggtcttgtctgtggaatttttattttctgcgatctgcttccagaacccctcacttgctgctattggctaattgcggtatcttttacacgcacctgcaaattcaggtgccgggattagcctcctgattgacttcatcgacgacacaaaggcgcgtctgcgctttttttgtgtcgtgcgttctgctacatctcaatggtgggccgggcgggggcgctgcaaagcgcgccggtgtcgatgaggccggtaaggctaaccccgtccggttccaccaccatgagattagcctctccggtggtggtgataaacactgctcatcggaggatgccttatggctacgaccctcacccagacacacccgctactctccgttcccttcaatgccgccacggatttcaccgtactggcagaacactgcaaacagttcgccgaaatcctgatcgaacacgacgatcccacgctgaaaatggcactttgcggcaggcttaatgcctgtctgcaacttcttcagccctcactgcttgatccgatcccggagcacatgatggacagcctgatcgttgatacgctccccacccgctcaccgcgtttcgatcccgaatgtactgaactttgtaactactgccttgccctgacgcaggtgctgacgggacaggggctattaccggaaaccagaaattaccttggctgcctgctgtacgacctgatccattatttttctgatgaaatcacggccccgcgctggctgcgtaccgctgacggcgtgaagtttattgacgaggtgacagcatgacgcaacaggactggcatcccgccgacattatcgcggggttgagaaaacggggcacctcgctggcggcgctgtcccgtcagtcggggctggcgtcctcaacgctggcaaatgcgctgataaggcactggcccaaaggcgaaaggctgattgccgaagcgttgggtattgcgccagagcaaatctggccttcccactaccgcaagcctgaaaattactaaatcgtctctcccgatcttctgatggctttgctgtcagaagatcgggagaaggcaagcgaagcgcggcagttcaggctcgcaaataatctttttgacgtacaaacagtttttcctttctgcgccagcggcactggcgtagtctccctcctgctccatgctgtcgtcgacagcgcccaacgcttcacaacctgaaagaagcgcctgttatcaggacggttgatccgtttaccggtgcagacctctgcaaacaccgggtcgcagaacatcgcgacggaggcccgagttttaacactatatgtcctttactgcgccagcctgctggtctgaatctgctccgcgccgaaattttcccggctaacctgtatctgctgacaccctctgcgccttttaccttacggactgcggcctgcaaagacagcaggctttgctgctgcgtggtcgtaaaactgcaccaacgataaattttcagacactgcaccagtccagtgcgtcactttaaccgcgtaaagcgggaaagtgacgcacgcagccttttcgacctgcaccagacaactcaactgcgccagctcatggctggattctgacactgccttttcaggccattttacccataaggagaacatgagccgataccgaggcggatccggacgatccgggggataacccgcacaagcgggcggctgctctgagagcacaaccgaagccccaccacacctcaacggctgccgccccggcgctcaggtatcgttcgcagccccgacaaaaaaacaggggctatcggcctgtgcgccggggaaagcggtatcagtgttggttttttgggatgagtttgcggcaatcatgaaagggggaaaatatggggattctggcgcaggaaatgaagcggcttgcacaacaggcgggcggcagccataagaccgttcacgatcgcattaagctggcgcagggcatcacgaagcgttccctgcaaaacgagatggcggcggtacgttgcattctgaaacaggccgggcgtgacaggctggcgcagagtgagcggctgaacaaccgttctcttggtctgtctggcgcatcccgcaacggtacaaagctggctatcacgccggagcactatcgtgacgtgctggagacagcccgtgtaaaagatccggggatggcggcagcgctggaactctcaaagctgatgggattacgctcgcaggaggcggtgcagagcgtacagtcgctgaaaacgtggcggcaggcgctggatcgtggtgacacccgcttaaccgtagtgtttggcaccaaaggcgggcgaccccgcgagacgattattcttgatgcggtagcagtcagaaaagcgctggataatgcgctggctgtggcagaagatcgtcacgacaggctgatagataagccggatctgaaaaccgcgatgaaatactggcacagtcaggcgtcacgtctcggcttaacgggcgcatattccccgcactcgttgcgctatgcgtgggcgcaggatgcgatccgtcattatctggcgcagggatttagtgagaaggaagcgctggcaatgacggcgatggatttggggcacggcgacggacgcggacggtatgtggcgcaggtttacgggagaaaggatggtggtgattgatagcttcagacttgcaatatgaggttatccatcggttttcgtacaaaaaattttgggggcaaaattttttgtacggtttccttttaataacgatgtttctaaatggtctagcctattaacaggcttctggtgcagcattccgttatttttttctggtgattgtgccagcaaaagggaaaaggccagataaaggtaaagggcggctaagggtaacagcgccagaccggaaaaggccaaagggcttaaaaggataaagctggcgcagatcggtatttatccggtggtatctggcgcaatcctgacatagacaggcgacggcagactggtgcagataaacgatgacactgaactggtgcagttatggcgtatcggcaaatcagtttctggtgcagattgtctggctgctatcgcctgaaattattctcctcaaataattttctatatttacctattgattcgcgaaatattgatagattttcgtacaaaattattctacgtagaataattttgtacgctttcctattaacaaccaaaaaatgcaaggtaattcctttcaatacaaaaagcagattcggattcaatcaggatctgctttttcattatcaacaaattatattgccgctggctcaggccgccttatgccgctgcgcataaatatagggcgcaacgtacccctcgcggctcatgtcgagataattcgaccaccactgcatcatctccatacgcgcttccagatgctccgctttatgtacatatgccgcacgcacgccgttgcgctccttgtggctcatctggcgctcgatggcgtccttagaccacagcgcagactcgttcagggcgctacaggccattgtgcggaagccatgaccacagacttcggttttggtgtcgtaaccacccgatctgcacttagaagtcgggtggctaaaagtattttatacttattcattaggaatgagaattcattcaaattttatgacttaatgatttattgcttttgtataggaacgattgacccaaccatagatcttttgttctccgaatgacagttgtacatataaccatttcctgtcacttttatcgataacgatcacgggagtatatttttccaacttaaccaatacatcgccttgcattgatggtgtgttccgtaatcggacattttctccagtaattattcttatgtgttttaatgtgctaatgtcaacttcgcggggtaactgttttgttaattctttaaaatgagttcttggtgatatagatttactaacatattgttgcgcttgttccattaaattcattgctaattctttgtttttatccacaacgactgaatacatggtggttacaagataaatgatgatgagttgtactaataatggtaattttctaaagtttgaagttatagggcttttttcgatataattttttaattttgttaatgcgtcaggctcttttacttctactgcatggatatttgttgcaataattgctgcaccttgaggtgagcgtgaaaatagaatggccgcttcctgtaatgtttgaatttcggttgcatctaatttttctaattgtttagcaatgcttgtagcgaaataattttcgttgaatatccccccctgctttttgaaaagagcggtaatgcccgagtcctgcaccagcttctgagctgcgaatgcgctgctgacagcggtactggcaaaaagtgattcatggcttttcaggaaagcggcaacgctggagccctgtgccagcttctgagttgcgaatgcgctgctgacagcggtaccggcaagaagtgattcatggtttttcaggaaagcggcagcgctggagccctgtgccagcttctgagttgcgaatgcgctgctgacagcggtaccggcaagaagtgattcatggtttttcaggaaagcggcagcgctggagccctgtgccagcttctgagttgcgaatgcgctgctgacagcggtaccggcaagaagtgattcatggtttttcaggaaagcagcagcgctggagccctgtgccggcttctgagttgcgaatgcgctgctgacagcggtaccggcaagaagtgattcatggtttttcaggaaagcggcagcgctggagccctgtaccagcttgtgagctggggatgcactgccaatagcggaaaacactgtgttctggagtttattttcactcataattgagggcttggatggtaagccagttccattctcattattgttgagcagtgtttttttctctttcatcatttcacatcctgaatgacggatttttattgataatataaggttttttcaatttatcgtataggacataacactgtgtgggcaatcattcgtttggagatacattagtactaagcactgcaaaagatgttcatctgaatgagccattttgtattaataggttttcgtacaaaaatattctacgtagaatatttttgtaggctttcctattaacaatcaaaaaattgaagttaaatcctttcaatacaaaaagcagatccggattcaatcaggatctgctttttcattatcaacaaattatattgccgctgggtcaggcagccttatgccgccgcgcataaatatacggcgcgacgtacccctcgcggctcatgtcgagataatccgaccaccactgcatcatctccatacgcgcttccagatgctccgccttatgcacatacgccgcccgcatgccgttgcgctccttgtggctcatctggcgctcgatggcgtccttagaccacagtgcggattcgttcagggcgctacaggccatcgttctgaatccgtgaccgcagacttcggttttggtgtcgtaaccaatcacgcgcagcgccttgttgatggtgttttcactcatcggcttgttcattgagtgagcacccgcaaaaacaaataccgactctccggtaatttcctttatctgctccagcagggcgacagcctgcgcagatagcggcaccagatgctcatccttcatctttgcgccacgctctgagaaacgcacgttcttcaccgcttcccgctttgctggcaccgtccagatacgagctttcaggttgaactcatcccagcgggcgaggcgtaactcactggagcgcaggaaaacgtgcagattcaactccagcgccagacgggtcagttcccgccctttgtagccattaatcttgtccagcagctccggcaggcgtttcaggggcagggcggggtgatgttgggtcacaacaggggtcacgacgccatccagatcgtaagccggattatatttaatcgttccctgctgtacggcatgacgcatgattttggtcagatgctggcgcacccgcccggcaacgtcatgcacgcccttatcgtcgatggatttaacaagctgcgccagatggcgggtttcaacctctgcaatgtccattgcgccaatatcggggaagacgtagcgcttcaggcaggtcaggatcttgtccgcgtggtcttctgaccacagcttaagacaactggagtgccacgccgtggcgatgtactgaaaggtgcgcgtaccgtcaacggcggctttttccgccttgcggggcagagaagggcaaacgccggataccagcagcttacgcgccgcatcgcgtttttcgcgggcttccgccagcgtaacctgcggataggggccgaaggccagacgattttccttaccttcaaaacggtagcggaaataccatagctttgaaccactggtggataccgtcaggtacagaccttgtgcatcagtgagtttataggattttgcgaggggtttcgcggcgcggatcttgctgtcagtcaacatgagggcctctccgttcatcgaactgaatgaaccttcaacctgacccctaattttccggatacgtagggataaatcaaaacgcatctggaaagatttttacgctaacttattgaattacatacatattggaattcatagggaagcataaaaaaggaaaggtggtgcccggactcggaatcgaaccaaggacacggggattttcaatcccctgctctaccgactgagctatccgggcaacggggcgcattaaaccgtaaaggggcgcggtcgtcaacggctttacacgaaaaaagtgataaaagcgcgctgactgcctgcttttcaggcaaaatgcataaaatcagtacccgtcaggtgagcgctccaccctgacggcactgtgcaaaacgcagaatatcttccgccaaccgctgagcggtatctacatcagcctgactgcggttgaccagcattcggctgagacaaccttccagcaccagttccatctgccttgcaaccatcgccggatcgtcaatttccagcgtggtcagtagcccatgggtaaaatcatgtgccgcgcgtttttgttgattagccagttggtgaataggatgggttgggtcgggataaaacgtacaggcggcaatgaacaagcaaccaggataacggttattactgacacattccgaaagcgcgctgtagcgtgccagtagcttttgttcagcagaaaacgtctcatcaagaagaagctggcgtcgccagatatctacctgctgactcagataacgtagcgcgtcatataaaatggcttctttatctggccagaaacgctgtaatgtgtcgagtgggcgatttacgcgctccgccaccatttccagcgtagtatcggctatcccttgcgtctccagtaatttcagggcttctcccagaatatcttcacgttgcacggtattctcctccgtctttgcttttgcaagtgtcgctcatggttggcgatcgtgcaaatgcgcgctaaaggtggcggcgtccataaagccggtgactcgcgcttgcggctgttcctggccttgggcatcaaagaacagaatggtgggcagcccgagaacttgcagatgctttaacagcgcgacgtcctgcgcattgttagcggtgacgttagcctgcaagagcaccgtgtcgccgagcacctgctggaccctcggatcgctgaaggtatacttttcaaactctttacaggccacgcaccagtcggcgtagaaatccagcataacgggtttgcctttggcctgcgccagcgcctgattgagttcatccacggtagaaatagccgtgaaattgaggtgcgctggagcttgcgcggatggcgatccgaatgcccaatcttgtagaggccgcacgctaatgagcgctgccgccagcaggataatctgtacgatacgcatccacgctcgtctggcctgaaggctggtgataaaggcccaaccaaagaaagcgacgcccagcagcgaccacagacgtaaaccccaagcctcgccaataatccgctccagtaaaaagaccggtaacgcgaggatcacgaaaccaaaagcggttttaacatgcgccatccacgggccgcttttcggtagcagacggttgccaaacacggtgaccagcattagcggcagacccatacctaatgcatacaaatacagcgtaccgccgcccagccacatgttgccgctctgagcgatataaagcaggatcgcgcttaatggcgctgtggtacagggcgagcaaattaatcctgcaatcgcccccataacaaaaacaccgccgggcgagccgccttgctgacgattactcattaatgtcagccgggtttgcagtgaggaggggagctgtagtgtgaacaggccaaacatcgacaacgcaagcagggtgaacacgatggcaaggccgattaacacataagggtgctgcagcgccgcctgaaactgtaatcccgccgcggcgacgaccagacccagtgcggtataggtcagcgccatcccttgtacatagataaaggccagcagcagtgcgcgccccgtcgacaaacgttgccttccccccaggacaataccggaaatcagcggatacataggtaaaacgcagggcgtaaaggcgatgcctatgccgatcagtagcgcccagagcgcagaaaaaggtagctgggcggcgggttttgacgtctcacccgtctgggtgacagcaggcgtcggcgtggcgtctattgccgcggcgacttcacttagcggcaccgttttcgtttccggcggataacagaatcccgcatcggcgcacccctggtacgttatcgttaatgtcgcgccagccgccgcctggttaaccgttaccggaacgtttagccgcttacggtagatttcgctttttccgtagaattcatcttcatgccagacgcctgccgggagttggactgcggcgatatccgctttcgtcggcgtgatactgatttgtttacggtaaaggtagtaaccctcttttacctgccaggagagggtaagatcgtgttgattttgctgaaaatcaaaaacaaacgcccggtcggcagggacgaactgcgagcgacccggcgcgtcgaataatccggcgaaggcggatgtgctgcacagcagcaggatcagcgtaaagatgcgttgagccatgagaggtaatcagtatctccgtgagtaacaggtaaaaccagaagttcaggcgtttgatacgggtgatgagacttcaggcagtcgataagcgcttgctgatgtgaaacggtggtttttaagatcatttgaacttcatactcctgctccagtttgccttcccagtagtacagcgatgtcgcgccggggaggagggtggcgcaggcggccagtttttccgccagcactttggcggccagatcctgggcggtagcttcatccggggcggtacaaagcaccacaacagcctcggggatggaaatatcctgactcttaacatcaagcataaacacctcgaaagaacaaaaagacccgcaagtgaacggtcactatacaacggacgagggcaggatgttagtcaaagggcgggagaatgcggggcgtgatacgccccgcgggtgaaacacttacagcataaagctgcccagcaggaagccggagcagatagccagaacgacgcccagggtgcctgggatgaagaacgggtggttaaagacgaatttaccgatacgggttgtaccggtgtcatccatctgtaccgccgcaaccagagtcgggtaggtcggcaaaatgaacaggccggaaacggcggcgaaggaagcgactgccgtcagcggagagacgttcagcgccagcgccatcggcatcagcgctttcgccgttgccgcctgagagtagagcagcgcggaagcaaagaagaagatgacggccagcagccacggatgcccctggatgacgctacccgcagtgtctttgatccagtcgatgttagcggatacgaaggtatcgcccagccacgccacgcccagaatacaaatacaggcgctcatccctgctttaaaggtactggagttgaggatggcgtcagtttccactttacacaggatggtggtcagcgttgcgacgctcaacatgatgatcaaaatagcgttggtggtgttcatcagcggtttctcaaccaggccgaggctcggactgttgacaatcgcataaacaaccacgcagataacgcccagcaggaacagccagacggaattttttgccatcggtttgatttcaatctgcttttcaccacgcagttcaatcagcccttcttccagacgcttgcggtaaatcgggtcgtccgacagtttggagttgaacagcatcgtgaccaggaaggacatcaccagcaccgccagcagcgtagaggggataaccacggacagcaggtgaatgtagctaatgccatgaccttccataacagaagacatatacaccacagccgcagaaatcggcgaggcggtaatcgcaatctgcgcggataccacggcggttgagagcggacggcaaggtttgattccctgctccttcgcgacttcagcaataaccggcagcgttgccagggaaatgttcccggtaccagcaaaaatagtcaggaaataggtcacaatcggtgcgaggatagtgatgtatttcgggttcttacgcagcagtttttctgtctggtttaccaaataatccagaccgcccgcgacctgcatagcagagatcgcggcgataaccgccatgatgatggaaatgacatcgaatggaattgtccctggcttcacgccgatggcggcaagtaccagaacacccagcccacctgcgaatccaataccgatgcccccaagtctggcgcccaaaaagattgccagcaaaacaatgataagttcgacaactatcatattagccttccttgttgtttaacaagttgatattaaattgttgttatttggtaacttcttgtaagaaaaaaggcacgtcatcgtgacgtgcctctttggtactaccctgtacgattactgttcgctttcatcagtataacgtttagctttataagccgggtgcatcaagttctgtacggagaaaatatcgtccagctcggcttccgttaacaggccgcgctctagcacaacttcacgtacgctcttaccggtttcagcacagattttaccgacgatgtcgccgttgtggtggccgatgaacgggttgaggtaagtgacgataccgatggagttataaacgtacccttcgcacacttctttattcgcggtaatgccgttaacgcatttttccagcaggttgtagcacgcgttgctcagaatgtggatggattcgaacatcgcctgaccgataaccggctccataacgttcaactgcaactgaccggcttccgccgccatcgtaacggtggtgtcgttaccgatgactttaaagcatacctggtttacgacttccggtactaccgggttcactttggctggcatgatggaagagcccgcctgcagttccggcaggttgatctcgttcaggccggcacgaggaccagaagagagcaagcgcaggtcgttacagattttggacatcttcactgccagacgtttcagcgcgctgtgaaccataacatacgcgccacagtcagatgtcgcctcaatcagatcttcagccggaacacaggcgaaaccagtgacttcagccagttttttcaccgccagcggagagtattctttcggcgtgttcagaccagtaccgattgccgttgcgccaaggttgacttccagcagcagctcagcagtacgctcgatgcttttcacttcttctttcagcagaatgctgaacgcacggaattcttgaccaagcgtcatcggtacggcgtcctgcaactgggtacgacccattttcaggatgtcctggaattcaaccgctttacgttcgaaaccttcacgcaactggttgatggcatcgatcagtttgacgatagaggcgtaaaccgctacacggaagcctgtcggataggcgtcgttagtggattgacatttattcacgtggtcgttcgggttcaggtactgatattcacctttctgatgacccatcagttccagcccgatgttggccagcacttcgttggtattcatgttgacggaagtgcccgcgccgccctggtagacatctaccgggaactggtccatgcacttaccgttgttaaggacttcatcacatgcggcaatgatggcattcgccacactcttaggaatggtttgcagctctttgttggccagcgccgccgctttttttaccataaccatgccacgcacaaattcagggatgtcgctgattttgttattgctaatgtagaagttttcaatcgctctcagagtgtgaacaccatagtaggcttcagctggaacttccctggtacccaacagatcttcttcgatacgaatgttgtttgacatgtgaaccttctttttcaagctgccaatgatttttactttaaaacacacaggatatatgtgatttcgaatgttttctgaccgacgattatcccctccatcggcctgataaacgagatcatatgctggttcagaattcctaccgtaatctggatcacttaaagtgtgggaatttaccccttatttattattttgtgaaataggtcaccgctttagtattactacctaaaataggtgtacaaaccacttgaaattttgctacgcaccaccatatcgaatcgatgcgaatcgcaaccccatttaaatggtcgtcgcagacggccatgacttacaggagagtcctttgcgctggataccctttttagctgtctttctctatgtttacattgagatttctatctttatccaggtcgcccatgtgcttggcgtcctgatgacgctaatcctggtgatttttacgtctgttatcggtatgtcgctggtacgtaaccagggttttaaaaactttttgctgatgcaacaaaaaatggcggccggtgagagcccggcggcagaaatgattaagagtgtatcgctgatcatcgctggcttactgctcctgttgccgggatttttcaccgattttctcggccttctccttttgttaccgccagtgcaaaaacatttgacgctgaagttgctgccgcatttacgtttttcccggatgccgggcggcgggtttagcgcgggtactggcggtggcgaaacatttgacggcgagtatcagcgtaaagatgacgatcgcgatcgtattgaacataaagacgatcgtcgggattaaaggtagagatgctggtcggataagtcgcgtgaggcgttatccggccaacagatacgtcttacgccatgcgttttcgcttcggtaaaaacagccataatgctgccagcataataatggcatataagcttttccaccccagcattactagcaataacaggcacagtagacaacccgtcaccgccagtgcatagcagcgccctttcaacagtcgacagcccgccagcatacaaagtagatagagcataataaaaataccgttagcatagacgatcagcgcattgaggttaatcttcagggcgtagacgaccagggaactcacgcaacaacaggccagaataacgtttaacgcgtgcaagggaaggcgcccgggagagagttgagccagatagtgatcgggctgatattgcatttgcgtccatatcagacgcgcaaaactctgagcatacatattcaggctggcaaagcaggtgagataaccaataatgcaggctatccacaacgcctggataccgaagagatgaacaataataagcggtagcgatgctgttgccgctatcttgtcgctatagacgccaaaatgcagcaccacggcggtacaggtccaataaatggcgccggccagcatcaggccaatgatcaatgcgcgcggaaaatcacgttcaggatttttaaattcagacgacaaatgcgtaaaagcctcaattcccacaaatccccagaacatgatcgccagggcggtacacagccgggaaaagatgatttcgtttgcggctgggaaggtgatatctgcaggtttaatcgcgcctttccacagaatggcggcaataagcgcgataattaatccagcgataatggcttgcaggttggcgctggagctggcgccgcgcgatcccataaaccatagcaaacctagagtacccagctccccaaataagagctgttcgctttgccagccaaacagcgcctggccgaaacccaccgcaatatgcaaggctgcgggaaaactaacaggaatgactgataaaaacagccaactgatcacccgttgcagacgcgggccaaatgccatcccgacaaaatgcgctacgccgccagcgtgtggaaaatgacgccccagcacagcaaagacaatcgcaatagggaaaatcaaaataatgagcagcggccatgcccaaaggctgatgtcgcctgccgccagcgcagccagctccggaagcgcaaaaacgccagtccctaataatgatgtggttaacaagataacgccctgaaccaacccaagctctttttttagttcattcatcagctcattatccggcggcattgtaacgtcaggtgacgacagacatttttaagcgtatcacacacgccttttcttatagcaggatgttctaaaccttgggtaaacgtgagataagtagcgtttttaccgcttttttcgctcagaagaattttttttcatctccccccttgaaggggcaaaaccccatccccatctctctggtcaccagccgggaaaccgtttacgggccggcgtcacccataactgataatgactttctcaaaggagagctatcaatgagtattcgtccgttacatgatcgtgtgatcgtcaaacgtaaagaagttgagtccaaatctgctggcggcatcgtactgaccggttccgcagcgggtaaatcaactcgtggcgaaatcatcgctgtcggtaagggtcgcatcctggacaacggtactgtacagccgctggacgtgaaagttggcgacatcgttatttttaacgatggctacggtgtgaaatctgaaaagatcgacaatgaagaagtgttgatcatgtctgaaagcgacattctggcaattgttgaagcgtaatccgcgaacgacactgaacatacgaatttaagggaaagagaaaatggcagctaaagacgtaaaattcggtaacgacgctcgtgtgaaaatgctgcgcggcgtaaacgtactggcagatgcagtgaaagtaaccctcggtccgaaaggccgtaacgtggttctggataaatctttcggtgcgccgactatcactaaagatggtgtttccgtagcgcgtgaaatcgagctggaagacaagtttgaaaacatgggcgcgcagatggtgaaagaagttgcctctaaagcgaacgacgctgcaggcgacggcaccaccaccgcgaccgtactggcgcagtccatcattaccgaaggcctgaaagccgttgctgcgggcatgaacccgatggacctgaaacgtggtatcgacaaagcggttgctgctgcggttgaagagctgaaggcgctgtccgtaccgtgctccgactctaaagcgattgctcaggtaggtactatttccgctaactccgacgaaaccgtaggtaaactgatcgcggaagcgatggataaagtcggtaaagaaggcgtcatcactgttgaagacggtaccggtctgcaggacgaactggacgtggttgaaggtatgcagtttgaccgcggctacctgtctccttacttcatcaacaagccggaaactggcgcagtagaactggaaagcccgttcatcctgctggctgataagaaaatctccaacatccgcgaaatgctgccggttctggaagccgttgcaaaagcaggcaaaccgctgctgatcatcgctgaagatgttgaaggcgaagcgctggctaccctggtagtgaacaccatgcgtggcatcgtgaaagtggctgcggttaaagcaccgggcttcggcgatcgtcgtaaggcgatgctgcaggatatcgctaccctgaccggcggtaccgtaatctctgaagagatcggtatggagctggaaaaagcaaccctggaagacctgggtcaggcgaaacgtgttgtgatcaacaaagacaccaccaccatcattgatggcgtgggtgaagaagctgccatccagggccgtgttgctcagatccgtcagcagattgaagaagcgacctccgactacgatcgtgaaaaactgcaggagcgcgtagcgaaactggcaggcggcgttgcggtaatcaaagttggcgctgcgaccgaagttgaaatgaaagagaagaaagcccgcgttgaagatgccctgcacgcgacccgtgctgcggtagaagaaggcgtggttgctggtggtggcgttgcgctgatccgcgttgcttctaaaattgctgacctgaaaggccagaacgaagaccagaacgtgggtatcaaagttgcgctgcgcgcaatggaagctccgctgcgtcagatcgtgctgaactgcggcgaagagccgtctgttgtcgctaacaccgttaaaggcggcgacggtaactacggttacaacgcagcaactgaagaatacggcaacatgatcgatatgggtatcttggacccaaccaaagttacccgttctgcgctgcaatacgcggcttctgtggctggtctgatgatcactaccgagtgcatggtgaccgacctgccgaaaagcgatgctcctgatttaggcgctgctggcggcatgggtggtatgggtggtatgggcggcatgatgtaattgcccaccccctgcatccttcaggctgcagatgcgttggctaaccccagtcacttacttgagtaagtgactggggattaacaaactggccgccttcctgcaaccagaatgatttgggtgcttatctcccagaattgagaaacccccgggcagaaatgaccgggggtttttcttttagtcatctttttagtataagattcagatacggacaaaacgtccagctcattgattatggggaataacatgcacgtgaaatatttagcagggatcgttggcgccgcgctgctgatggcgggttgtagctccagcaacgaactcaccgctgccggccaaaatgtacgctttgtcgaagataagccgggcgcggaatgccagcttattggtacggcaactggtaaacagagtaactggttttcaggccagcacggcgaagagggtggctcaatgcgtggcgcagcgaacgatctgcgtaatcaggcggccgcgatgggtggaaacgtgctgtatggcgtaagtagtccgtcgcagggcatgttgtccagttttgtcccgacggccagcgagatgaacggccaggtttataaatgtccgaattgacatgtctgaatcgtaacgccctctgaaagattcagagggcgatatggttagcgtttttcctgcgatgacgccatgcgtagattatgcaacgcgcgcatacattgatcttgcgtcagacgcgctgctttaccggttccaagcgttctgacaaaaaccttacacggttttccttccagctttttaagacgcgggctgaaattcagcaagcggcgtgatatcgcttcagcttctttagagcctgactgactgcgggtcttaatgatggtgccgcaatcatgcgattgtcctgcctcatccgtataacgataaacgagcgctaaataatggttatacagattatgtttccagtcaggctggttataggtatcgaattcgatattaccgttatccaggcagtcagcatcgtataatggtaaaaagtccagcattgaagaaatacgcaatgcgagctcacgcatttcggcattattaatggcgtgaataatagccatcaccagaacttcaacctgccactcaccgacctgtaaatcaagatggctaccattgtgcagctttaacgtaaaggttaatactttttctgtattatcgctcaacgctaaagattcaacacgctgattaacatcggcgttttccagctcttcacggagtattgccggaatattctcatgcattttaagcacatgactgcttttggctttctggcgtttttcctgctcttgttccggaagcgagtattgtaaataaagccggtgttcaaggccgatcaacaagtctcgcagcgcgagcacaggaaagaaaagcagtgtttctttatttctcagtgacttcaccttaagcgccagcgcgataaacttatcattgtgacgaataacgccggtatttagtcccttaatcgttaaggccatgtcaattctccacaaatataaaataattaaatgttttactgcaatgtatttgatatataaattgtttatgccgtcctataaaaaggagaaccagtataattcgaaaatgcagtacacgctaagcgagtcctaaaacggactttattgaaaagagagtatcggaaaggtgtatttaacgaaggttagtttatcctcgccagagggtgaggagaatcgcgggggaatctcctcgtgatattgcgcggtaatatttttcgtcgtccctgacgcgcccgcgaggattagcactgccgaagctgtaaatccagcggtgttttgctcggttcgccgccgatttcacgcgccagtcttggcaccatatagccggataccagcgtgagcagttcgcgcatgatttgccgggcttcgtcatcggtgaccataaaatgcgcggcgccctgcactttatccagcacatgcaggtaatagggcatcacgccggcgtcaaatagcgcgttgctcagattcgccagcgtttgcgcgttatcattcacgccacgcagcaggacgctctggttgagaagcgtgacgcccacgtggcgcagtttcttcatcgccaggcagaacgcctcgtccacttcattggcgtggttgatatggttcaccaacaaaatttgcagacatgactggtcaaagcgggcgaccagttcgtcagtaatgcgtgccgggataacgataggcaaccgactgtggatgcgtagccgcttgacgtgcttaatggcttccagttgcgtgagcagccagtccagctcatgatctttcgccatcagcggatcgccgccggaaaagatgatctcatccagttccgggtgtgcggcgatatactccagcgcgactgtccagttgcgcttattgccttgattctccgcatacgggaagtgacgacggaaacagtagcggcaatttaccgcacatccgccttttaccagcaatagcgcccggttttggtatttatgcaataatcctggcaccacgctgtgttgctcttccagcgggtcggtggagaaaccgggggcgacaataaattcatcccgggacgtcagcacttgacgtaaaagaggatcgtcagggttgcccttctccatgcgcgcaataaaagcgcgcggcacgcggagggcaaacaagcgcctggcgtcctgtcttgcccggaggttttcatcagcttcaatctgtaaaagatgcagcagttcgtcgggattggtcacaacatcggcaagttgcgctaaccaatcttctcgcaatggggtatttagggttacaatatgcgccattttgtggcttagctaccagttaacaatttcagagggccttatggcgacttactatagcaacgattttcgttccggtcttaaaatcatgttggatggcgaaccttatgcggttgaatccagtgaattcgtgaaaccgggtaaaggccaggcgtttgcccgcgttaagctgcgccgtctgctgaccggcacgcgcgttgagaaaaccttcaaatcgaccgattccgctgaaggcgcggatgtagtcgatatgaacctgacttacctgtacaacgatggtgagttctggcatttcatgaacaacgaaaccttcgaacagctgtctgcagatgccaaggctattggcgacaacgcaaaatggctgttggatcaggcggaatgcatcgtaaccctgtggaacggtcagcctatctctgtcactccgccgaactttgttgaactggaaattgttgataccgacccaggtctgaagggcgataccgcaggtactggcggcaaaccagccacgctgtctactggcgcagtggttaaagttccgctgttcgtgcagattggcgaagtgatcaaagtcgatacccgttccggcgaatacgtatcccgcgtaaaataatttacgttatcgggaaaaatggtgcagcgtatgctgcgccatcctatttttcgcgcctcaatgatgaaacgctttatcggccttgtcgcgctggttcttcttaccggcacattattaacggcatgtaataccgcccgcggcttcggcgaagatattcagcatcttggccacgccatctcccgcgcagccagctaatcgcttctcgtcttcctaaaattagtcgatcgcccgtcattttctgggatgttgtctattattaagttgctatacacaaacaacattggctagaaaaggaagacattatggttaaaaagacaattgcagcgatcttttctgttttggtactttccactgtattaactgcttgtaataccacgcgcggcgtgggcgaggacatctcggacggtggtagtgcgatctctggcgctgcaaccagagctcagcagtaatcatcaacggtacggcatggcgtcgtaccgttaatcgattttctccggaagcataagaaagggagaataccggttatccatatgaagtttcatacggatattacgcttataggtgtaaaccgtttttccgtgaatgccaagcgcatacgcaatctctttattgctggtgccttccgtccacatcgcgagcactttttcctcctgcggagagagcaatggcgtggcgctttccggcgcttcctgcagtggatgagtatatagcgctcctttaattcgttgtgcaagctcatgtaaaggcgtgtgtttagataacaccgcatggctggcatattgcgatctgtacggcatattccctgactgtaataatactaacggcgtcatcctgcaggcggcaaaaaatgcattgataggctgctcgggtaaggcatcgttgagaaaaccatataaatcagcgataaccagatggggcttccattgcagaatatgttctttcgccagtataaggttattcatcccggataccagcagtgaagaactgagcacatcagtgtgattaagccaggcctccatgcccgtacgggtaaagtggcatcggtctatcactaaaattttcaacatagttttttgtacccggaagtagtaaagcactttctttcccagaaggcgttccatcatagagaactcctgtgggcgctaaatgcgaaaactacgcggcttaaaagggccaattcccgcctttagacggaaaaaaataaaaaggttgaaattcattttctctcaggcaagaatggcttttcatccgtatacgttacaggacgacctgtaaacgctattctcaccggggacggccccattaattatctggagcctgctatgtcctggatcattttattaatcgctggtttacttgaagtggtatgggctgtcggcctgaagtatacccacggtttttctcgtctgacccccagtattatcaccattacggccatggttatcagtatggcgttactttcctgggcaatgaaaacgctgcctgttggaacggcgtacgccatctggaccggcatcggcgccgttggggcggcaatcaccggtatccttctgctgggcgagtctgcctcaccggcgcgtttgctcagtcttggcttgatcgtcgcgggtatcattgggctaaaactcagtgcgcattaattcgtcgctgacattgctacgaacctgattgttttacccaaattaatttattgacgtcaaacccctcccgggtcgcgacggccagcatttgctgttttatttcctcagaaagcgttggcgtgcgagagagtatccacagatagtcgcgattcgggccgcacaccagcgcatgacggtattcccggtcaagcgcaatcacgttatagccgccgtagaacgggccgaaaaaagagaccttgagcgcggcgcggtttggactaccggtaaaatacgctttgccttctgttttttgccacatttcccgagccgggttatagcctttattgatgacattaatcccgccatcgtcacgcagactataggtggtcgtgacttgttccagtccacgttcaaatcgatgatcgaggcgtgcgatctcataccaggtgtcgaggtaacgtttggcatcaaagttatttaccacggtaacgcctttaggcggggtaggcgaactacaggcgacaaccaaaaatgccgcagtaaccgcagcaacgacgggcagcaagcgcatagcgtttttccttccagtgttttttctaagtgtagaacctggcgggaaaatgagaggcaggaaaagaaaaaatgccctcttatcgggtagataagagggcgtcgtggcaacttagagagtgataacgccaatcgccgtcacaacggtcaggattgccgccagaccgtagaagacccatttgcccgcaggcacgtggattttcaggtcatgcatcgcgtggtgcatacggtgtaggccacaccatagcggtagcacgatcatcaggaacagaaaaacgcgaccaataaagctttgggcgaacgtcagtacgcgctcaaaactcagggcatcgcccggaaatagccccagcggcagcatgatgccaaccagtagcacgatcaccggcgcgatgatcgcgccccacataccgcctgcgccaaacagtccccagaatacgggttcatcagaacgttttgggtttggattaatcatccgggactccttaccagaacagggcaacatacagaatgactacggtgactaccgcagtgaccacccaaagccctttgatgattggctctggccccattttttcgtcttttacaatgatattggccgtcttcggcgccagttcaaaccaggttttggtgtgcagcagcgcggccgccagggtgatcaggtttaagatcactaccaccgggttttgtaaaaagccgacgaatcccatccaggattccgcgccgtgtttgagcgcaaacagaccgaaaatcagttcaatactgaaccagactgccggcaccgctgtgccttcgcgcagcatataaaagcgataaaacggcagttttttccaccaggtggacgtcatcggccgcacatagggtttgcgtttagtcgtcatgttgcactccttagcgtggtttcagggtggcgataagaaagtctttcgagctttccactttaccctgctgaatggccgcagccggatcgacatgttttggacagacttcggagcagtagcccacgaaagtacaggtccatacgccgttcggactgttcaactgcgccatacgctccttcttaccgtgatcgcggctatcttcgttatagcgatgcgccagcgtaatcgcagccggtccgataaactcaggattcagaccgaactgcgggcacgcggcatagcacagaccacagttgatgcaaccggagaactggtgatacttcgccatttgcgccggggtctggacattcggcccctgatctggcgtgcgagagttgccaataatgtacggtttgatcgcttccaggctttcgataaagtgcgtcatatcgataaccagatcgcgctcaatcgggaagttcgccagcgcttccaccttcataccgttggtgtaatcgcgcaggaaggttttacacgccagtttaggaacgttgttgaccatcatgccgcaggagccgcagatcgccatacggcaggaccagcggtagctcaggtctggcgacaggttatctttgatgtagcccaacgcgtccagtagcgatgttgtttcatcataaggaacttcatagaaagcactgtgcggcgcggtatcggtttccgggttatagcgcaccacctcaactttcaggtttttcatctcagccattcgccttctccttcttatcggctgcttccgcttcaccgccgtaaacacgtttggctggcggcagggtggtgattttcacgtcgctgtattccaggcgggtcgtgccatcagcatcgcggaaggcgagggtgtgcttgaggaagttcacatcgtcgcgctcggtacagccttcatccagacgctgatgcgcgccgcgggactctttacgcgccagcgcagagtgcgccatacattccgccacgttcagaccatgacccagttcgatggtatacagcaggtcagtgttgaacacgctggaagtatcggagatacgtacgcgcttgaaacgttcctgaagctcggccagtttatcaacggttttctgcatcagttccggggtacggtaaataccgcaaccttcttccatagacagacccatctcatcgcggatcttcgaccagttttcgttgccttcctggttcaccagatttttcagacgctgttcaatatcggcaacctgggcgtcgagcgcggcgctatttgcggcgcctgccgtagcagcgcgttccattgcttgttcgccagccagacgaccaaacaccaccagttccgccagtgagttggaaccgaggcggttcgcgccatgcaggccaacagaggagcattcgccaacggcaaacagccctttgacacggctttcacagttctggtcggtttcaatgccgcccatggtgtagtgcgcggtcggacgtactggaatcggttctttaaccggatcgacgccgacataggctttcgccagttcgcaaatgaacggcagacgttcatgcagtttcttctcgccgagatgacgcaggtcgaggtgaaccacatcgccgcgcggcgtggagatggtgttgcctttacgccattcgtgccagaaagcctgggatactttgtcgcgcggccccagttccatatatttgtttttcggctcgcccagcggcgtttcggggcccatgccgtagtcttgcaggtaacggtagccatttttattgaccagaataccgccttcgccgcggcaaccttcagtcatcaggataccggaacctggcaggccggtcgggtgatactgaacgaattccatatcacgcagcggaacgccgtggctcagcgccatgcccatcccgtcgccggtgacgatgccgccgttggtgttatagcggtatacgcggcctgcgccgcctgtcgccatgaccacggcgttggcgcggatttgtaccagcgtgccttccatcatgttcattgccaccaggccgcgcgcatggttgtcatcaaccagaatatccagcacaaaatgttcgtcaaagcgctggatttgcgggaactgtagggaagtctggaacagggtatgcagcatatggaagccggttttatccgcggcgaaccaggtacgctcgattttcataccaccgaagcgacgcacgttaacgctaccgtccggacggcggctccacgggcagccccattgctccagctgcgtcatctcagtgggacaatggtggacaaagtaatccacgacatcctgctcacacagccagtctccgcctgctaccgtatcgtgaaaatggtagtcaaagctgtcatgatcctgggcgacagcggctgaacccccttcggcagcgacggtgtggctgcgcatcgggtacacttttgagatcagtgcgattttagcattgggattcgcctgtgcggcagcaattgcagcacgtaatcccgcgccaccagcgcctataatggcaagatcggcttgaaaggtttgcacgacattcctccagattattgtaatttcaccctcgcgcagccagataaagcctctgggttctgcgaagtatgaatgcgtttccactgctcctttatgggtacaacagtatagtctcagggatgtgagggaaatttgacgtgttcgatttttttagcgtatcagagggatgaattatcattgattttgattaatttaattactaaaccatctgaaatcactttttttaccctccagaaggcacccgatacgcctgcgcaaaatttgtttcgcccgcgcgttgcgagtagacttcgtgaccttgtcttaaactggagaaagaatcatgagcgaaacggcaacctggcagccgagcgcgtccatccccaatttattaaaacgtgcggcgattatggcggaaatccgtcgtttctttgccgatcgtggagtgcttgaggttgagacgccctgcatgagtcaggcgacggtcacagacattcatctgttcccgttcgaaacgcgtttcgtcggacctggccattcccaggggatcaacctctatttaatgaccagtccggaataccatatgaaacgcctgctggcggcagggtgcggtccggttttccagctatgccgcagtttccgtaatgaagagatgggacgacatcataatccggaattcaccatgctggagtggtatcgcccgcattacgatatgtaccgcctgatgaatgaagtggatgatttgcttcagcaagtgctggattgtcaacttgcggaaagtctctcctatcaacaggcgtttctgcgccatctggagattgacccgttatcagcagataaaacgcagctgcgtgaggcggcggcaaagcttgatttaagcaatatcgccgatacggaagaagaccgtgatacgttgctgcaactgctgttcacgatgggggttgagccgcatataggtaaagaaaagccgacctttatttatcactttccggccagtcaggcatcgctggcacaaatcagtaccgaggatcatcgcgtcgccgagcgctttgaggtgtactacaaaggtattgagctggcgaatggtttccacgaactgacggacgcacgtgagcaacaacagcgctttgaacaggacaatcgtaagcgcgccgcgcgcggtctgccgcagcagccgattgaccaaaatctactggatgcgctggccgccggtctaccggattgttccggcgtggcgctgggtgttgatcgtctggtgatgctggcgctgggagcagaaagcctggcggacgtgattgcttttacggtcgatcgggcgtaaatctgaaattcactctttcgcgagataaaatggcgaaataagcgccattttgtagcatattttttcaattatcctctgtttgccacaacataaggctggaactttgatgccatttaggtatcaattctgtgttgatttttttatcgctgaccttcgtaaaaaagaaggcggcgtcaatcggtgagcggcgtctggcaaacgcgctcgagcgtaagggatggttgaatgacccacacgataaaaaagatgagccttattgggcttatcctgatgatttttacttctgtttttggttttgcgaatagcccgtcggcgttttatttaatggggtatagcgcaatcccgtggtatatattttctgccttgctgttttttattccattcgccttaatgatggctgaaatgggttccgcttatcgcaaagaagagggcgggatctattcgtggatgaataatagcgtggggccacgttacgcgtttattggcacgtttatgtggttttcatcgtatgtcatatggatggtaagtacggcggcaaaaatttgggtaccgttttctacttttgtttttggcgccgatatgacgcagcactggcgtattgcagggcttgagcctacgcaggttgtcgggctgctcgccgtcggctggatgattctggtgacgtgtgtcgccgccagagggatcaataaaattgcgcgaattacggcggtcggaggtattgccgtaatgtgtcttaatttagttttattgttagtgagtgtcgctattttgttattaaatggtgggcattttgcacaagagattaattttacctcgtcaccgaatccgggttatcactccggcctggcaatgttgtcatttgtggtatttgctatttttgcttacggcggtattgaggctgtcggcggactggtggataaaaccgagaaaccggaaaagaattttgcgaaaggtattgttttcgcggccattgtgatttcaattggttattctttggcgatctttttatggggcgtcagtactaactggcaacagatattaagtaatagcgccgttaacttagggaatatcacctacattctgatgtcgagtttaggcacgacattaggtaacgcgttaaacctttctccggaagctgcgatgacggtgggcgtctggtttgcgcgtatcaccggcctttctatgtttctggcttataccggcgcgttttttacgttgagctattcaccgctgaaagccattattcaggggacgccaaaagcgttgtggcccgcgccgatgacgacactgaacgctaacggtatgccggcgaccgctatgtggctacagtgcgtgctggtgagtctgtttattttgctggtctcttttggcggtgacaccgcatcggcgttttataacaaactcacgctgatggcgaacgtctcaatgaccttgccatacctgttccttgcgctggcatttcccttctttaaagcgcgtcaggatctggagcggccatttgttctctttaaaaccaaagcctctaccctggtcgcgacgggtgttgtggtgctggtggtgacgtttgccaacgtctttaccatcatccagccagtgattgaagctggggactgggacagcgccttgtggatgatcggcggcccgatcttcttctcgctgctggcgatggcgatttatcagaattacagcagccgcatgagcgctgatccggagtgggcggcggagtaaaggccgtatgccggataaggccccacgggtcgcatccggcgtttattgccctatggagaacgtgatgaatgatagttcgagagacccgattatcacggaagatgagattagggcactcaattttactccggaagatatccttgaaatagaaaaggttattctttcttccgttcatgttgcacgtcgaaaggttgcgatggtagtaggaatgactattggcacgttaagggatcgcgatgaggataagtggaaacatgtgtcggatatttattgcgcgtatgttgtaagatgcctcgtatttcgcggagaactggtgggttacggcgatttattccgaatgcgctatagcgaaattaacctgcctgttgccgatctggacgcataataagtccgaaaatgtctgtgagttgcgatgaaatgcccgatggcgcaagcttatcgggcctacagattaattgtcggcccgtaggccggataagacccgacggggcgcatccggcatttcttgccgggatcatgcgctacaaactccccgccgggcggctggttttacccgctgacgttaacgttctccccgtttgtttaccgccgagactctccagacgcatctggaacggcgggaacggcatatcaataccgtgctcgcggaagccagccagaatcaattggtggatctcatggcgtaatggcatacggtgtcccatttccgcggcatagatacgcagttcaaaaatttgaataccctgctggagatccaccagaaagatttcaggcggcgggttatcaagcaccaaagaacagcgctgcgccgccgtcagcagaatttgcgtcacctcttcgctattggcatccgccggcgccgggatggttaacaccacgcgcgtaacggagtcagacagcgaccagttgataaactgttcggtgataaaggctttattcggcacgataatctctttacgatcccagtcgctgatggtggtggcgcgggtattgattttggtcacgctgccggtgagatcgcgaatggtcaccgtatcgccgatacgaatcggcttttcaaacaaaataatcaggccggagataaagttagcgaaaatttcttgcaggccaaaaccaagcccaacgccgagcgcggcaaccagccattgtagcttcgaccactcaatgccgatcatcgagaaaccgaccagcccgccaatcagcattaacagatatttggtgatggtcgtgatggcgtaaccggtacctggcgttaaatcgagatgctgtaataacgccagctccagcagcgcaggcagattacgcaccaactgcgtggtgatgataaagaccagaatcgcaatgagcaccgcccccagggtaatcggctccagactttccacgccttgcaccgtagaggtgacatcccacagcgaaatattctccaggaagccgaatgccgagtggatttccgaccacagtacaattaccgatagcagggcgataagcatcagaattgagcgaaccagacgcagcgactgagcgctaatagcgtcaagatcgatttcactttcatcgatgtcgaccgcgccttccaggctggaggagtgcgccggttcttcttcgccgcgcgcgcgctgcgccagcatttccgcccgacgatgtttggcgcggtcaaaagccagtcggcgtcgttggatcagcatccagcggcgaatgacgtgataaatgaccagcaacaggaatcagatggcgaccgaggtttccagtctcgccagtagcgcctgcgccgtggccagataacccaccgccgccgccagaatcgcgataagcggcgcgcccatcaacatattccacaacaggctgttgaccatgttgtcgccgttgccttctttatcaagatagagcgggatgcccgcttttttcagactcagcgtgaccagcgccagcgcgccgcatatcaggatgaagcaaaggcggcccaacgagccggaaaactcccgatcgttaagattatcaaacatgatcactgccataatgagcggcacgatcagcccaatgctcatcaggtagtagcgcatcgctttcgctacccggtttcgcggccagccgaaatgcgccacaaacagaccattagggcgggcaaaagcggcgcaaatcatgactacccacaacagcggtactgtcgccgtcacgccatcgccgatggcgacggccagcggatacggccaggcttcctgtagaccatagccgagcgtcgcccacaagacgggcagcggcgaggcgaccagaatcgaccagaacaccgttcgcagcgtcagcgagaagtgatcctgggtgactttcccgacgcgcgaggccgagcgctcaaggaaccggttgaagtgttggcgtgaatagaggctaaacccgaccagcgccagcgcgccgaataacggcagtagcgtctctttgctggtcagcatcatgatgctggctttacctaactgattaaacgtatctaatgagataagccgacgtaaatcctgaaccaaatcaacaggccaggagagcgatagcgggctaacgtcagcggtccagaacagataacggtgggtcgcttcattaacctctttaagcgcatcctccagttggctgttggagactttcagtttggtcaactccaggatcagcgtgtcgccgccctgtaacaaagagttgagcagctcgcgctgagtgcgaagctgggcgtcaagaatctggttttgctcggcggtcagtggttgtccattggcctgacgtatttgccgtagctgcggttgcttattgagtaattcttcatagcgcatacggtgaacgcgtagctgcgccatttccgtatcaagctgctgcggcttaggcatctctggcagacgggcgacctgcgcgcgcagcgcttcgccaagcatgttggacacgccaagccattgcgactgctcccgcagcgtattgagcgcctgacgcacctgtaacgtttggctggtggcctgtcgctgctgcgaggcgaccagatccatccgctgcgcttgttgattgagcgcctgtgacagcccgcggttgactttaaattgttcgacgatgccttccggcaaaccggcgctgttttccgccagcagctcagtgctttccagcgcgcgttccgcttcacgttgacgcaggctgttgagctgattgcgcagcgcctgaagatacgcatccaattgctgactctgtttttccgccagctcggaacgcagacgagccagttcctgccggttgttggcggacagttgcgccaactccagttcgtcgactaacgcttttagtttggcggactccgcctgcatactgagactttgcgcctggctaagcgcggcacttccgcctgcggcgccgagtcgtcgctcaatctcattaagctggcggcgggcgtcgttttgctgttggggaagctggctgagcgagtcggcgatctccctgacgcgctcctgctcctgttgcgcctcgcgggttttatccagtagctggctgctaacctgcaagatctcctgatttaacgcttcggtggacatctctggcggtacgctgcgaggttcatcgcgcagattattcaactgggcgcgcaaggtggcggatagcttagggaaattatcaataacgtgttgatattgtttcgcgcgctcaagcgagccttttcgctcttcaagcgcgtttaacgcagtctggagcgcctcaacggcttccggctgagcgggtttcgccgcttttgcctgctccagttcctgcgtgatttgtttggcgtcgggggccgttgcggcgaacgcccccgtgctgaggcaccaggccatcagaaaagcgataatcaggcgcacgtcagcattctctcttgattaggtgtcgtcttttttattgtcaaccagcgggctggcgtcgtgttcagctttaatttcttctgccggcagcggagcaggttccacctccggcgcgacgaatgtttcggtcgacgtcgccagcggttggccaattttggtaacggacaggcttgccagcgacgcgatcagattcactttccccggcgcaaataagttgatgaccgtggaacccagtttaaagcgccccatctcctggcctttcaacaaggcgacagacccttcatgttcgccttctggccaggtccagcgcttgatgatgccttcgcgcggcggggtaatggtccccgcccagacggtttcgatactgccgacaatagttgcgccgaccagaatctgcgccataggcccgaactcggtatcaaacagacagataacgcgctcgttgcgggcaaacaggttggggacgttttgcgcggtcagatagttaacggagaacagatcgcccggcacgtagatcatttcgcgcaggatgccgttgcatggcatatgcacgcgatggtagtcgcgaggggagaggtaagtggtcacaaacgtgccgttgcggaacttatccgccatcaggtagttacccgccagcaacgcttcaaggctgtaattatggcctttggcctgcaaaattttatcttcttcgatacgacccaactggcttatcacgccgtcggcaggcatcaccaggatgttaggatcggtattgagcggacgcacgtcatcacgcagcggacgaacaaagaaatcattgaacgtacgatagctggcggtatccggtttttgcgcctcggtcatatcgactttgtaatactttacgaagagatcgataaccagttttgtcagccatcctgctcgtttgcttgcgccccagcccgccaggcgagtgagccatagtttcggcagaatgtattgtagcgaaagtttaaatgagtttaacaaggtagcctccaggccattgttgttcctgaaccggcagttataccggtatcctgaaaaaaggggacgattctaacgacgcctagcgtatctgtcagtcgtccgtatcagaaaagtttttacgcgtttttacctgcgccatactttcaagaattcggtgataattttcgaaacgggtttccgcaatagcgccgttctctaccgcctcgcgaatggcgcagcctggatcggcgtcatgcttgcagtcccggtatttacaatgtcccaaatagtcatgaaattcgacaaagccctgggtgatttgttccggctccagatgccataagccgaactcgcgcacgccgggggaatcaatgacatcgccgccatgcgggaaatgatacagacgagcagcggtagtggtatgttgacccagaccggagacattcgacacatcgttcgtcagaatctcgttctgtaagccgagcagagcgtttagcagactggattttccgacgccggactgcccggcaaaaatactgatgcgaccggttaacgcttcttccagcggtttcagaccatcctgcgtatggctggagaccatcagcacgcgatagccgatattgcggtagatattcatctgctcattaacgaagtccataccttcgtcgtccagcagatcaattttattgagtacgataagcggctcaacctgtagggtttcacagccgaccagatagcgatcgatgatattcagcgacagctccggcaaaatcgcggagacaataacgatttggtcaatgttggcggcaataggcttcacgccgtcgtagaagtccgggcgcgtcaataccgaggtgcgctcatgcaccgcttcaacgatgccttttacgttgacgccctctgcggcggctttgcccggacgccagacgacgcgatcgcccgtcaccagcgaacggatagtgcggcggatattgcagcggtgaacctcgccgtcagcagactccacatcggcatgcataccaaaacggctaatgacgataccttctgcaggctcgccaaacaggttgtcatcgtagtcggctttctccgcggacgtttttaaacgacgctggtgattggcgttcacacggcgctgctggcctttggagagtttatttttgctcaatcgtactggctcctggtcgcccatagtgggcaaaacatctatgatacacgcaattgtagatgaatatagtcacagtgaatgtgacctctgaagggtggaaaatagcatgagtgccgatgaaaacaacctgatttggatcgatctggagatgacaggtctggaccccgaacgcgatcgcattattgagatagccacgctagtgacggatgccagcctgaacattctggcggaagggccgacgattgcggtacatcaatccgatgcgcaactggcgttaatggatgactggaacgtgcgcacccataccggtagcggcctggtagatcgcgttaaagcaagtacgatgggcgaacgagacgctgaactggcgacgattgaatttctgaaaacgtgggtgcctgcgggtaagtcgccgatttgcggtaacagcatcggtcaggatcgtcgttttctgtttaaatatatgccggaactggaggcttacttccactatcgctatctggatgtcagtacgctcaaggaactggcgcgccgctggaagccggagattctggccggctttaccaagcagggcacgcaccaggcgatggatgatattcgcgagtcggtggcggagctggcttactaccgcgagcatttcattaagctgtgaggcgtaacatgccggatggcaacgccagagcgtctcatccggcagctctcccgccactgaattactgcgtaaaccatttctcctgcatttgcgcatattccggcgacgctttcaccttgtcgagcgcggcattaatttcttgcaatagcgcgtcgttgcctttgcgtaccgcaatgcctaacccttttccgtagtagtcaggatcgctggcgcgttcatccatgatggcgtaatccggattgttttttagccacttaccaatcgcggcgacatcgccaaacacgccctcaagacggttatttttcagatcggtaaaagcgtttagatagctgtcataggcgacaggcgtgatagcttgttgtttatcctgcaaatagcgctgatgcgttgtaccgttttccagtccgacttttttgcctttcagatcggcaaaagtgtgataagcccctttacgcgtgacgactaccgccgataaaccttcgtaatagggttggctaaaggagacctgctgctcacgtttgggcgtcatatccataccggcgatcaccgcatcaaactttttgaaacgtaggccggggatcagactatcaaagctctggttagtgaatgagcactccgcttgcatctctttgcagaccgcgttggcgacatcaatatcgaaaccaacaattttattatcggcatcgacaaactcatagggcgcataggtggcggaggtgccaaaatgtaatgttctggcggaaacggaagcagcgtgaacggagaggctggctaacagcatgacaataagttttttttcatcttgatccctgatatcaattggatgttgtggtcaccgtgctattctttttttggcgcagggtgctattctgattctgtgcctttaggcgtggcgtgaaaagttttttgttgcatagcgcacgctttgctcgttttttgtcttgtttggtgatttaatcagcattcaaacaaaaatcgcgaaaaaatgcgttcaggggcttgcagctaaatggatttctcgtataatgcgcctcccgtaacgacgcagaaatgcgaattacgacagcaacaaatttgcgggaatagctcagttggtagagcacgaccttgccaaggtcggggtcgcgagttcgagtctcgtttcccgctccaaaatttgaaagtacttgttaagtacaaaccaccaatcgcaggatttcgaattgcgacaaggcggcaactgaatgagtcctcaggagcttactgaagtaagtgactcaggcgagtgaaggcagccaaggcagtagcggttcgaaagacgaagattatgcgggaatagctcagttggtagagcacgaccttgccaaggtcggggtcgcgagttcgagtctcgtttcccgctccaattcttatctacagtaaaattatccacaacgaatatcgcgttggggcacgttttgttccgctttcgtcagatccttgtaaacagacttatccacaggacggcccattactcctggaatgcaaaaaattatacctgacgcgtagaatttctataatttactgaaaaatatagaaaaaataagatttcaaaacgttagcgttattgtctgttccttttttccctcttgaatcgcaatgtgtttttatttttatacacagcctgtgaataattcaggcatcgcgcaccagccctttttcaatcaccctgaccagacgctgttttttcggtagctgcacttcaatgatgcaggcgttccgcttttcaatttgttgcgcaatcgcccattcgatattctcatcaagaagtggatgctcacccttgcggctttccaacgccgtaatgacggcattactccacggcgcattccccagcgcaacggcaacattgcgcagccagcgtaaatggccaatgcgccgaatcgcagaaccttcagtgactttcagaaactgcgcttcgctccagctaaacaactcaagcaaatctgggttatgcagcgccttgcgtgggctaaaatctgcttcgtcggtcaactgagagtaacgattccacggacagataagctggcagtcatcgcagccgtaaatacggttacctatcagtgggcgaaatgcttccggaatagcgccttccagctcaatggtgagataagaaatacagcgccgcgcgtccaccgtatacggttcgacaatcgccccggtcgggcaaatggtcatacaggcgacgcatttgccgcaaccttcctcgaccggctggtcgaccggcagcggtaaatcaatcagcaattcccccaggaaaaagaatgagcccgcctcccgattaaggataagtgagtgcttacccgtccagccaagtccggctttttccgctaatgggcgttcaagaataggcgcagagtcgacaaacggtctaaaattcagcgaaccgcagtactgctggatctgctcgcccagttttttaagacggctgcgtaacagcttgtgataatcacgccccagcgcatatcggctaacgtagcccagcgtgggatccttcaacgtactggcaaacgcggcgttggcgggcagatagttcatgcgcacgctgatgacacgtagcgtaccgggtaagagttcatgaggccgggcgcgcatcataccgtggcgcgccatccatgccatctcgccgtggtattgtttgtccagccacgcctgcagcgcaggttcggatgcgcgcagatcggtatcagtaataccgacctgctgaaagcccagctccagcccccactgcttaatattttgcgctaactgattgagatcgaggggctttgacatgatggaccataacatgaagaaaaaccctgtaagtataccacactccatttggcccgccgatgacatcaaacggctggaacgcgatgcggcggatgccttcggactcacactctatgaattgatgctgcgcgctggcgacgcggcatttcgggtagcccgtgacagttaccctgacgcccgacactggctggtgttgtgtggtcatggcaacaacggcggcgatggttacgtcgtggcgcgactagcgcaagcggcgggcattagcgtaacgttgctggcgcaggagagcgacaaaccgttacctgaagaagcggcgcaggcgcgcgatgcctggctgaatgccggcggcattatccatgctgccgatattatctggccggaagcgacggatctgattatcgacgcgctgcttggcaccggcatagcccaggagccgcgcgatccggtagccggtctgattgaacaggcgaacgcccatcctgcgccggttgtcgccgtcgatatcccgtcaggcctgctggcgcaaacgggcaccacgcctggcgcggtgataagcgccgcgcatacggtcacgtttatcgccctgaaaccaggcctgctgaccggcaaagcgcgtgacgttaccggcatattgcattatgacgcgttggggctggaaggctggctggcgagccagacgccgccgctccggcgttttgacgcgacgcagttggggcaatggttaacgccgcgtcgaccgacctcgtataagggcgatcatggtcgtctggcgattatcggcggcgatcagggaacagcgggtgcaattcggatggctggcgaggcggcgctgcgtacgggggctgggttggtcagagtactgactcgcggtgaaaacatcgcgtcgttgctgacggcccgcccggaactgatggtacatgaactcacgcctcagtcgctggaagagagcctgacctgggctgacgttgtggtgatcggcccggggcttggacagcaggaatggggcaaaaaagccttacagaaagtagaaaacgtccgtaaacctatgctgtgggatgcggatgcgttgaacctactggcaatcaatcctgataaacgtcacaatcgcgtgattacgccgcatccgggagaggcggcccgcctgttaggatgttctgtggcagaaattgaaagtgatcgcttactttcagcacagcgtctggtaaaacggtatggaggcgtggtcgtgttaaaaggcgcaggaacgattattgccgctgaacaccaccctctggctatcattgacgctggtaatgcggggatggcgagcggcgggatgggcgatgtcctgtccggcatcatcggcgcattgctcggacagaagtttaccccgtatgatgcggcatgtgtgggatgtgtggctcacggcgcggcggcggacttactggcagtgcgttatggcgctcgcggcatgttggcgaccgatctttttactacgctgcggcgtattgttaaccctgatgtgattgacgtaaaccatgatgaatcgagtaattccgctacctgacgaacaggcgacgctagacctggggcaacgggtagccaacgcctgtgatggcgcgaccgttatttatctgtatggcgatttaggtgccggtaaaacgacgtttagccggggatttttacaggcgttaggccataacggtaatgtaaaaagccccacctatacgctggtagagccttatgcgcttgataacatgatggtatatcacttcgacttataccgtcttgcggacccggaggagctggagtttatgggcattcgcgattatttcgccaacgacgccatttgtctggtggagtggccgcaacaaggtaaaggcgttctccccgacccggacgtcgaaatccatattgattaccaggcgcaggggcgtgaggctcgcgtaagcgcggtatcctcatcgggtcattcgttactggcgcgtttagccgattagctataaaggtggcgggatgatttatcgcatcaaaaatgccgtaatagcagccttaatcctgctgtgcgcgcaggcgggcgccgccagtctctctgatattcaggtgtccaacggcgagcagcaggcgcgcattacgctgagttttatcggcgagccggaatatgcttactcacaggacggtaaacggaccgtggcgctggatatcaggcagaccggcgtgattcaggggctgccgcttcagtttagcggtaacaatctggtaaaaacgatccgtgccggaacgccgaaagatgcgcaatctttacggctgcttgtcgatctgacggaaaatggtaaaaccgaggcggtgaagcggcaaaacggcggcaactatacggtcattttcaccattaatgccgatgttccgccgccgccaccgcctgtcgtcgcgaaacgggttgaaagcgcgccccgcccgacggagcctgcccgtaatccgtttaaatcttctgatgatcgcctgaccggcgtaaccagcagcaacaccgttacgcggcctgcggcgcgcgcgtcggcaggcgctggcgataaagtggtgattgctattgatgccggacatggaggccaggaccccggtgcgataggcccgggcggtacgcgcgagaaaaatgtcaccatcgccatcgcgcgtaagttacgcacattgctgaataacgatccgatgtttaaaggcgtgctgacgcgtgacggcgactattttatttcggtgatggggcggtctgatgtggcgcgtaagcaaaacgccaacttccttgtctctattcatgcggatgccgcgccaaatcgcgacgccaccggcgcctccgtctgggtattgtccaatcgtcgcgcgaatagcgaaatggcaaactggcttgagcagcatgagaagcaatccgaactgttaggcggcgctggcgatgtgctgacgaacagtcagtcagacccttacctgagccaggcggtactggatttgcaattcggtcattcgcagcgggtagggtatgatgtggcgacgaacgtactaagccaactcgacggcgtggggtcgctgcataaacgtcgcccggaacacgcgagcctgggcgtgctgcgttcgccggatatcccgtccattttggtggagacgggttttatcagtaatcacggcgaagaacgattgctggcgagcgaccgctatcagcagcagattgctgacgctatataccgggggttgcgtaagtactttgcagcgcatccgatccagtctgcgccgcagggcagcccaggccagacggccagtaccaaccagcctggcgctataaccgccgcgaattaaggagatttcatgccgattcaggttctgccgccgcagcttgcgaaccaaatcgccgctggcgaagtggtggaacgccctgcgtcggttgttaaagagctggtagagaatagtctggatgcaggcgccacccgcgttgatatcgacatcgagcgtggcggcgcgaagcttattcgtattcgcgacaatggctgcggcattaaaaaagaggagctggcgctggcgctggcccgtcatgccaccagtaaaatcgcctcgcttgacgatctggaagcgattatcagtctgggatttcgcggcgaagcgctggcgagtatcagttcggtctcgcgtttgacgctaacgtcgcgcacggcggagcaggcggaagcctggcaggcgtatgcggaagggcgcgacatggacgtgacggtaaaacccgccgcgcacccggtcggcaccaccctggaagttctggatctcttttataatacgcccgcccggcgcaaattcatgcgtaccgaaaaaacggaatttaatcacatcgatgagatcatccgtcgtattgcattggcccgttttgacgtcacgcttaacctgtcgcacaacggcaaattggtacggcagtatcgcgctgtcgcaaaggacgggcaaaaagagcgccggttaggcgccatctgcggcacgccgtttctcgaacaggcactggcgatcgagtggcagcatggcgatctgaccctgcgcggctgggtcgccgatccgaatcacaccaccacggcgttaacggagatccagtactgctatgtgaatggccgcatgatgcgcgaccgcttgatcaaccatgccattcgccaggcctgtgaagataaactgggcgcggaccaacagcctgcgtttgtgttgtatctggagattgacccgcatcaggtggatgtcaatgttcatcccgccaagcacgaagtgcgttttcatcaatcgcggctggtgcacgacttcatctatcaaggggtgctgagcgttctacaacagcagacggaaacgacgctgccgctggaggagattgcgccagcgccgcggcatgtcccggaaaaccgtatcgccgccgggcgcaaccattttgctgtacccgccgagccaactgcggcgcgcgagcccgcgacaccgcgttattccgacggcgcatcgggcggtaacggcgggcgtcagtccgcaggtggttggccgcacgcgcagccaggctatcagaagcagcagggcgaggtttatcgcacgcttttacagacgccgacgacgagccccgcgccggagccggttgcgcctgcgcttgacggacatagccagagttttggtcgcgtactgacgatagtcggcggtgactgcgcgttgctggaacacgcggggactatccagctcttgtcgctgccggttgcggagcgttggctgcgtcaggcgcagcttacaccgggtcaaagtccggtttgcgcgcagccgttgctgattccgctgcgtttaaaagtgagcgccgatgaaaaagccgcgctgcaaaaagcccaatctttgttgggagaattgggtattgaatttcagtcagatgcgcagcatgtgaccattcgggcggtgcctttacccttacgacaacaaaatttacaaatcttgattcctgaactgataggctacctggcgcaacagaccacatttgcaacggtcaatattgcacaatggatagcgcgtaatgtgcagagcgaacatccgcagtggtcgatggcgcaggccatatcgctgctggcggatgttgagcggctatgtccgcagctggtaaaagcgccgccgggtggcctgttacaacctgttgatttacattcggcgatgaacgccctgaagcatgaatgatgtaagcaaggtgagcctgcctaaggcgatatttttgatggggccgacggcctccggcaaaacggcgctggcgatagaactgcgtaaagttttgccagtagagttgataagcgttgattccgccctcatttatcggggaatggatattggcacggctaagccgaatgccgatgagctgaaagcggcgccgcatcgactgctggatatacgcgacccgtcgcaggcgtattcggcggcggattttcgccgcgacgcgttagcgcaaatggcggagatcaccgctgcggggcgtatcccgctgttagtgggcggtaccatgctgtattttaaggcattgctggaagggttatcgccgctgccttcagcagatccggaagtcagatcccggatagagcagcaagcagcggagcttggatgggaggcgttgcatcagcaacttcaggagatagatccggttgccgccgcgcgaattcatccaaatgatccgcaaagactttcccgggcactggaagtttttttcatttcgggtaaaactttaacggagctaacgcaaacgtcaggagacgcgctaccgtaccaggtgcatcagttcgctatcgccccagcgagccgtgaactgctccatcagcgcattgaactgcgttttcatcagatgttggcttcaggttttgaagcagaagtccgggcgctttttgcccgagaagatttgcatacggacttgccttccatccgttgtgtgggataccgccagatgtggtcatacattgagggcgaaatctcatatgatgaaatggtttatagaggtgtttgctccacgagacagttggcgaagcgccagatgacctggttgcgcggttgggaaggggtgcgctggcttgacagtgagaatcccgatcgggcgcgaaaagaagtattacaggttgttggtgctatcgcagactgaatgtgtacaattgagacgtatcgtgcgcaatttttcagaatcgaaaggttcaaagtacaaataagcatataaggaaaagagaatggctaaggggcaatctttacaagatccgttcctgaacgcattgcgtcgggaacgtgttccagtttctatttatttggtgaatggtattaagctgcaaggtcaaatcgagtcctttgatcagttcgtgatcctgttgaaaaacacggtcagccagatggtttataagcacgcgatttctactgttgtcccgtctcgcccggtttcccatcacagcaacaatgccggtggcggcgccagcaataactaccatcacggtagcaacgcgcagggttctactgcgcaacaggacagcgaagagactgaataagttcacgcgctgtttatccatgtcgggggcgtcggataatcgcccccgctggttattaagagggtttacgcttgtttgaccgttatgatgccggtgagcaggcggtactggtacacatctatttttcgcaagacaaagatatggaagacctccaggagtttgaatctctggtctcttccgccggtgtcgaagcaatgcaggtgattaccggtagccgtaaagcaccgcacccgaagtactttgtaggtgaaggtaaggcagttgaaattgcggaagccgtgaaagcgactggcgcagcggtcgtattgtttgatcatgcattgagtccagcccaggagcgaaacctggagcgtttgtgcgagtgccgggttatcgatcgcaccggtcttatcttagatatttttgcccaacgtgcgcgtacccatgaaggtaagttgcaggttgagctggcgcagctacgccatctggctacgcgtctggtgcgtggctggacccaccttgaacgtcagaaaggcgggattggtttgcgcggtccgggtgaaacccagctcgaaaccgaccgtcgtttactgcgtaatcgcattgtgcagattcagtcgcgcctggagaaagttgagaagcaacgtgagcaggggcggcagtcgcgcatcaaggccgacgttccgacggtatcgctggtgggctataccaacgccggaaaatccaccctttttaatcagatcactgaagcgcgggtctatgcggcagatcagctatttgcgacgctggaccccacgttacgtcgtattgatgtagcggatgtcggtgaaaccgttctggcggatacggtaggctttatccgccatttaccgtacgatctggtggctgcctttaaagctaccctgcaggagacgcgtcaggcgacgctgctgctgcatgtggtcgatgcggcggatgttcgtgtgcaggaaaacatcgaggcggtaaacaccgttcttgaagagattgacgctcacgaaatccccaccttaatggtgatgaacaaaatcgatatgctggacgactttgaaccgcgtatcgacagagatgaagagaataaacccatccgcgtttggctttcagcgcaaagcggcgtgggaataccacagctttttcaggctttgacggagcgtctttccggtgaggtggcgcagcatacgctgcgtttgctgccgcaggaagggcgtctgagaagccggttttatcagcttcaggcaatagaaaaagagtggatggaggaagacggtagcgtcagtctgcaggtacgaatgccgattgtcgactggcgtcgcctctgtaaacaagaaccagcgttgatcgaatacgtgatctagacgcgaagtcattcaggtcgtattgaagcggtagctgagagaatttcaggagctcacaacgaagtgacctggggtaaaaaagccgccactcaaggcgtagcctgaaagatgatgtctgtaacggcggttcgtctgaagcatggagtaatttcgccttatcctctgaggtcgaaagacaacggggatcaccgcataacaaatatggagcacaaacatggcgtggaatcagcccggtaataacggacaggaccgcgacccgtggggaagcagcaaacctggcagcaactctgggggaaatggaaacaaaggtggccgcgatcagggacctcccgatctggatgatatcttccgtaagctgagtaaaaaactcggtggttttgggggcggtaaaggcaccggttccggcggcggtagctcatcgcaaggcccgcgtccgcaactgggaggccgtattgtcgccatcgccgcggcggcagtagtcattatctgggcggccagcggtttttataccattaaagaagccgagcgcggcgttgtgacgcgttttggtaaattcagccatctggtagagccaggtctgaactggaagccgacatttattgacgacgtcacgccggtgaacgtcgaagcggtgcgcgaactggcggcgtcaggcgtgatgctgacgtctgatgaaaacgtcgtgcgcgttgaaatgaacgtgcaataccgcgtcaccgatccgcagaaatatctgtttagcgtgaccagcccggacgatagcctgcgtcaggccaccgacagcgcgttgcgtggcgtcattggtaaatacacgatggatcgcattctgaccgaaggtcgtaccgttattcgtagcgatacccaacgcgagctggaagagactatcaaaccgtacaacatggggattaccctgctggacgtgaacttccaggctgcgcgtccgccggaagagatgaaagccgcctttgacgacgcgattgccgcacgtgaaaacgagcagcagtacattcgtgaagcggaagcgtataccaacgaagttcagccgcgcgccaacggtcaggcgcagcgtattctggaagaggcacgtgcctataaaacccagactatcctggaagcgcagggtgaagtcgcccggtttgcgaagattttgccagaatataaagccgcgccgcagattacgcgcgagcgtctgtatattgaaacgatggaaaaagtgctgagccatacccgtaaagtactggttaacgacaagagcggtaatttaatggtgctgccgttagatcagatgctgaaaggcgggaatgcgccggcggcaaagagcgacaatagcgccagcaacctgctgcgcctgccgccgtccacaaagtctaacgccagcggagcaagcaacacgtcgtcctcaaatcagggcgatattatggaccaacgccgcgcgaatgcgcagcgtaacgactaccagcgtcagggggaataacgatgcgtaagtcagttattgcgattatcatcatcgtgctggtagtgctctacatgtccgtctttgtggtcaaagagggcgagcgcggcattacgctgcgttttggtaaagttctgcgtgacgatgagaacaaaccgctggtttacgcgccgggtctgcactttaagatcccgtttattgaatcagtgaaaatgcttgatgcgcgtatccagacgatggataaccaggccgatcgctttgtgactaaagagaagaaagacctgattgtcgactcctacatcaaatggcgtatcagcgactttagccgttactatctggcgaccggcggcggcgatatttcgcaagccgaagtgctgttaaaacgtaagttctcggaccgtttgcgttctgagattggtcgcctggacgtaaaagacatcgtgaccgattctcgtggtcgtctgactctggaagtgcgcgacgcgctgaactccggttcagccggcactgatgatgaagtggcgaccccggcggcggatgacgcgattgccgaagcggcggaacgcgtcacggcggaaaccaaaggtaaagtaccggtcatcaacccgaacagtatggcggcgttgggtatcgaagtggtcgatgtgcgtattaagcagatcaacctgccgaccgaggtttctgaggcgatttacaaccgtatgcgcgccgagcgtgaagcggtcgcgcgtcgtcatcgctcacaaggtcaggaagaagcggaaaaactgcgtgcggctgctgactatgaggtgacgaaaactctggcggaagccgagcgtcaggggcgtatcatgcgtggtgaaggtgatgctgaagccgcgaagctgtttgccgacgcgttcagccaggaccctgatttctacgcgttcattcgtagtctgcgcgcttacgagaagagcttcgaaggtaatcaggacgtgatggtactgagcccggacagcgatttcttccgctacatgaagacaccgagttcgacgacacgctaaaatagcgtcagcggttttagaccagcaaaaccaccgcatccaaaggatgccggtggttttcttttataagggcgataaatgaattcaacaatctggttggcgcttgctctggtattagtcctcgaagggctgggaccgatgctgtatcccggcgcatggaaaaaaatggtttcggcactggcgcaactgccggaaaatgttttacgtcgttttggcggcggacttgtggtcgcgggagttgtggtctactacatgttgaggaaaacgattggctgagcaaaaagtggtcggatttgccgcagattgagtgcaaaaagtgctgtatatctgaaaaagcgatggtagaatccatttttaagcaaacggtgattttgaaaaatgggtaacaacgtcgtcgtactgggcacccaatggggtgacgaaggtaaaggaaagatcgtcgatcttctgactgaacgggctaaatatgttgtacgctaccagggcggtcacaacgcaggccatactctcgtaatcaacggtgaaaaaaccgttctccatcttattccatcaggtattcttcgcgagaatgtaaccagcatcatcggtaacggtgttgtgctgtctccgagcgcgctgatgaaagagatgaaagaactggaagaccgtggcatccccgttcgtgagcgtctgctgctgtctgaagcctgtccgctgatccttgattatcacgttgcgctggataacgcgcgtgagaaagcgcgtggcgcgaaagcgatcggcaccaccggtcgtggaatcgggcctgcttatgaagataaagtggcacgtcgcggtctgcgtgttggtgaccttttcgacaaagaaacctttgctgaaaaactgaaagaagtgatggaatatcacaacttccagttggttaactactacaaagctgaagcggttgattaccagaaagttctggatgatacgatggctgttgccgacatcctgacttctatggttgttgacgtttcagacctgctcgaccaggcgcgtcagcgtggcgatttcgtcatgtttgaaggtgcgcagggtaccctgctggatatcgaccacggtacttatccgtacgtaacttcttctaacaccactgcgggtggcgtggcgaccggttccggcctgggcccgcgttatgttgattacgttctgggtatcctcaaagcttactccactcgtgtaggtgcaggtccgttcccgaccgaactgtttgatgaaaccggcgagttcctctgcaagcagggtaacgaatacggcgccactaccggccgtcgtcgtcgtaccggctggctggacaccgttgccgttcgtcgtgcggtacagctgaactccctgtctggcttctgcctgaccaaactggacgtgctggatggcctgaaagaggtgaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactacatcaaacgtatcgaagaactgaccggcgtgccgattgatattatttctaccggccccgatcgtactgagacgatgattctgcgcgatccgttcgacgcgtaattgatggatgatgcccggtaacgctacgcttaccgggtctatgatgagtacgcatttgttggccggataagatgctttgcatcatgcacttcggctcaaatgcgtcattgttccccgcttttttccttcctgaaccgaaataaattagcagcctgacaggtggctggtttatcatcaatacagataagttatatcccgttttcccttttcctgaggttgatgtgcagttaacgagtttcaccgattacggcttacgtgcgctaatctatatggcgtcgttaccagatggacgaatgaccagcatttctgaggtgacagaagtctacgacgtgtcccgtaatcatatggtcaaaattatcaatcagcttagccgggcgggctttgtcaccgccgttcggggaaaaaatggcggtatccgcctgggtaaaccggctaatactatttgtattggcgatgtggtgcgtgagctggaacccttatcactggtcaactgtagcagcgaattttgccacatcacccctgcctgtcgtctgaaacaggcgctttctaaggccgtgcagagttttctcaaggagctggataactacacgcttgccgatttggttgaagagaatcaaccgctttataaattattactggtggagtgaagtaaacttcattagagatgacaatggaggaacctcaatgtcacaagatcctttccaggaacgcgaagcagaaaaatacgcgaatcctatcccgagccgggaatttatcctcgaacatttaacgaaacgtgaaaaaccggccagtcgcgaagaactggccgtagaactgaatattgaaggcgaagagcagcttgaagccttgcgtcgccgcctgcgcgcgatggagcgcgatggacaactggtctttacccgccgccagtgctatgcgctgccggaacgcctcgacctgctgaaaggcaccgtgatcggtcatcgtgatggttacggtttcttacgtgtcgaaggccgcaaagacgatctgtatctttccagcgagcagatgaaaacctgtattcatggcgatcaggtgctggcgcagccgctgggcgccgatcgtaaaggtcgccgcgaagcgcgtatcgtccgtgtactggtaccgaaaaccagtcagatagtcgggcgttatttcaccgatgcgggcgtcggctttgtggtgccggacgacagccgtctcagcttcgacattcttatcccgccagaagacgtcatgggcgcgcggatggggttcgtggtcgtggttgaactgactcaacgtccaactcgccgtactaaagcggtagggaaaatcgtcgaagtgctgggcgacaatatgggtaccggtatggcggttgatatggcgctgcgtacccatgaaataccctacatctggccgcaggcggtagagcagcaggtcgccgggctgaaagaagaggtgccggaagaggcgaaagtcggtcgtgtcgatctgcgcgatttgccgctggtcacgattgatggcgaagatgcccgtgactttgacgacgcggtttactgtgagaaaaaacgcggcggcggctggcgtttgtgggtcgctattgctgacgtgagctattatgtacggccgccaacgccgttggatcgcgaggcgcgcaatcgcggcacgtcggtttacttcccgtcacaggttgtcccaatgttgccggaggtgctctccaacggcctgtgttcgctaaacccgcaggttgacaggctgtgtatggtctgtgaaatgaccatctcggcgaaaggtcggctgaccggctacaaattctatgaagcggtgatgagctcccatgcgcgtctgacctataccaaagtctggcatatgctgcagggcgatcaggatctgcgtgaacaatatgcgccgctggtgaagcatattgaagagctgcacaacctctacaaagtgctggataaagcgcgtgaagaacgcggggggatctcgtttgagagcgaagaggcgaagtttatctttaacgccgagcgtcgcattgagcgtatcgaacagacccagcgtaatgacgcgcataagcttatcgaagagtgcatgatcatggcgaatatctcggcggcgcgctttgtcgaaaaagctaaagagccggcgttattccgtattcatgataagcccaccaccgaagcgatcacctcattccgctccgtactggcggagctggggttggagctgccgggcggaaataaaccggaaccgcgcgattatgccgaactgcttgaatcgattgccgacaggccggacgccgaaatgctgcaaactatgctgctgcgttcaatgaagcaggcgatttacgatccggaaaaccgcgggcactttggcctggcgttgcagtcttatgcgcactttacctcgccgattcgccgctatccggatctttctttgcaccgcgccattaagtacctgctggctaaagagcaagggaacaagggcaacaccacagaaacgggcggttatcactactcgatggaagagatgttgcagctcggccagcactgttcgatggcggaacgccgcgctgatgaagcgacgcgtgatgtctccgactggctgaaatgtgactttatgctggatcaggtaggcaacgtctttaagggcgtgattgccagcgtcaccggtttcggcttctttgtccgtcttgatgaactgtttatcgatgggctggtacacgtttcctcactggataacgattactatcgcttcgatcaggtagggcaacgtctgattggcgaatccggcgggcagacatatcgcctgggcgaccgggtcgaggtacgcgtcgaagcggtgaatatggacgaacggaaaattgactttagcttgatttccagcgagcgcgcaccgcgtaacgtcggcaaaacggcgcgtgaaaaagcgaaaaaaggtgaaagtaaaaacgccggtaaacgtcgtcaggtaggtaaaaaggttaacttcgagcctgatagcgccttccgcggcgagaaaaaagcgaagccgaaagcagcgaagaaagacgcgagaaaagcaaaaaagccatcggctaaaacgcagaaaatagccgcagcgaccaaagcgaagcgtgcggcgaagaaaaaagcggcagagtgagcaataccctcttcaaacagaagagggtcaattatctgtaggccgggcaagcgtagcgcccccggcaaaacgtaaacaacgagtacattaatgagcgaaatgatttacggcatccacgcagtgcaggccctgctggagcgcgcccctgaacgttttcaggaagcctttattttaaaaggccgtgaagataaacgtctgttgccgctgattcacgcccttgagtcccagggcgtggttatccagctggcaaaccgccaatatctcgacgagaaaagcgacggtgccgtgcatcagggcattatcgctcgtgtgaaaccaggccggcagtatcaggaaaacgatctaccggatctgatcgcattacacgatcgcccctttttgttgatcctcgatggcgtcaccgatccgcataatcttggcgcctgtctgcgcagcgccgatgctgcaggcgtacatgcggtaatcgtgccgaaagaccgctccgcgcaacttaacgcgacggcgaagaaagtcgcctgcggcgcagcggaaagcgtgccgttgatccgcgtcaccaacctggcgcgcacgatgcgcatgttgcaggaagagaatatctggattgtcggaacggcgggcgaggctgaccatacgctgtatcagagcaaaatgcctggccgcatggcgctggtcatgggcgcagaaggtgaaggtatgcgtcgtctgacccgtgagcactgcgatgagctgatcagcattcctatggccggtagcgtgtcatcgctgaatgtctctgtggcgaccgggatttgtctgtttgaagccgttcgccagcgtacctgacgctaatagtattttttaagaaaaaaccatccataatcggatggtttttttttatctttggctggtaatataaaaagcaaaacctaccctgtaactccctttatttataaaaaagagatagagataataatatggcatggactccacggacgctggcggatgcgttaaacaacatcgccgaattagatattgatatagaaaataatgaatcttcattaataataaaaatgaatgattatggcgatttaccactgacggttttatttacctcgcaacaaatagttatcgagacttatatctgtccggtaaatacgattagagataccgcggaatttaatcttttcttgctgagaaatcagaaggttttaccgctgtcttcggtcggtattgccctggtaaaacaggaggaatattatgtcgcttttggcgcgttgtcgttaaattcgtcgcttgccgacgtgacgctggaaatcaccacgcttgtagaaaatgcgttggatatcgctgaaataacacaagtctattcacaggaataatacaggcggcttacatgggaattttaaaaagtttgttcacgttaggtaaatcattcgttgctcaggcagaagaagccattgatgaagcacagggtgtacgtatgctggagcagcatattcgcgacgcaaaagccgagctggataaagcgggtaaatccagagtggatttattggcgcgggtgaagctaagccatgacaagctgaatgatttacgtgcgcgtaaagtcagccttgaaacgcgggcgttggcggcaatgagtaagaatgtcgacgccgctttactcaacgaagtggcggaagaaatagcccgtctggaaaatgccattcttgccgaagaacaggtgctgactaatctggaagcctctcgtgatgcagtggagaaggccgtaacggcgacaggccagcggattgcgcagtttgagcagcaacttgaagtggttaaggcgacagaagccatgcagcgcgcgcagcaggcggtgacgacttcgaccgtcggagccgcgtcgaatgtgtctacggcggcggagccgcttaaacgtttacaaacgcgtcaggctgaacgctaggcacggctggatgccgccgcgcagctggaaaaagtcgccgatggacgcgacctggacgaaaaactggcgcaggcgggtattggcgcaaccaataaaagcaatgctcaggatgtgttggcgcgtttacagcgtcaacaaggcgaataatgctctttacgtggatggtcaaaacctgccagcgtcatttgtccagactgacctggcccgctttgctgggcctgtttatcgggcagtatctgctttgctatctgtagcgcgaaagcgcgctaccgtgctgagcttcgtcgctttcatacgagacggcacatgaatgcgcgatctcaaatgacattatgcccaacgacaatcgcattctgtctgaagaggtcgcatggcaagagatagaggttcccctatgatgcaattttttcagcgtttgctcggtaaaacaagcacgccagcgccgattcgcggaccattaggattacatcttaacgccggtttcacgctggatacgctggcattccggctactagagtcgtcgttgctggtggcgctaccaggtgaaaaatacactgtcgcggcagcgagtcgcatagatttaggcggcggcagtcagatttttcgctactacacctctggcgatgagtttctacaaattaacaccactggcggcacggatgttgacgacattgatgacatcaaactttttgtatatgaggaaagtttcggtattaacgaggaacgtcactggcgttcagccattgcgccagcggcaatagggccgatgacgctcaactggcaagaacggcgctggcagcgcttttttaaccatgaagagccgggcaatattgaacttgtctacatgctggaaaaggttgaaaatcagcaggcagagaaatgggacgttcacaattttacgatgggtttccagcgccaggtgacggacgacgcctgggagtatcttctattgaacggggaagaatcatttaacgagcgcggtgagcctgaatgggtgttttcacgcgccctcggcgtggatatccctctcacttcactaacggttattggttaagcacatacagggaaattatgcatatactggacgcattactggctttctgcgcctatttttttattggcgcggcaatgatcattgtatttctttttatttactcaaagataacgccgcataatgaatggcagttgataaaaaataacaatactgcggcatcgctggcctttagtggtacgttgctgggctatgtcatccccttatccagcgcggcgataaactcagtcagcatcccggactattttgcctggggcggcattgcgctggtgattcagctgctgatttatggttgcgtaaggttatacatgcctacgctgagcgaaaaaattattcatcacaacgtggcggcggggctatttatgggaaccgcagcgctggctggcggtatttttaacgctgcctgtatgacatggtaacggaagatcatggcaaaaaaacgaaaatccagaagcacatccggcgtaggccattcggcaataagacggatagccgaaccggtcaatccctttgagcggcaacgaaatcgctacacgccaaaatacctgacgctggcgattatgggtggagcggccttttttctcctgaaagggtacggtgacggcagcaatagtgacaacgacggcgatgggacgttttacgccacggtgaacgactgtattgacgatggcaatagcgccagcgtttgcgctgacggctggaataatgcgaaaacagaattttacgctaatgtgcctaagcaattgacgcaggagagctgtcagtcgcagtttggcgattgctactttgatatcaccgagcggagctgggttccggtattaagcggctttttactcagccgcgcgattcgtcagaaccgtgatgaacaatacatctatagcagcggcggttcatcttacgtctcccgtcccgtctggcgcaccacatccggcgattatgcgtggcgcagcggcacagggaaaagcgataccgtgaccagccctggttatatcatacggaaagcgtccaccgtctcccgcggcggctatggccgttcttccagcgcccgcgggcactggggaggctaaccatgctacgacataacgtaccggtacgccgggatctggataagatcgcatgcgatcacggttttgactttcatgttatcgataacgaaatttactgggatgaaagccgggcctaccgttttacattacggcaaattgaagaacagatcgaaaaaccgaccgcagagcttcatcagatgtgtctggaggttgtcgagcgggccgtccgggatgagcagatcatgcagcagctggcgatcccgccattgtactgggatgtcatcgccgaaagttggcgcagccgcgatccttcgctttacgggcggatggatttcgtctggtgcggcaaagatccggttaaattgctggaatacaacgcggatacgccgacatcgctctatgagtcctcctactttcaatggctatggctggaggatgctcgtcgtagcggcgccatcccgcgtgatgccgatcaatacaacgcgatacaggagcggctgatcgcccgcttcagcgagctgtacagtcgggaaccgctctacttttgctgttgtgaagataccgacgaagatcgtacgacggtgctgtaccttcaggattgcgcgcagcaggcgggccaggaaacgcgatttatctatattgaagaactggggcttggcgtaggcggcgtgctgaccgatctggacgataacgtgattcgccgcgcctttaagctctacccgctggaatggatgatgcgcgatgacaacggcccgctattgcgaaaacgtcgtgagcaatggattgagccattgtggaaaagtattctgagtaacaaagggctgttgccgttattgtggcgctttttccctggccatccgaatcttctgccggcttggtttgagggcgaaaaatcgctcgcagcgccaggtgaaagtagcgtacggaagccgatttattcacgtgaaggcggcaacgtcacgatttttgacgagcggcaaaatgttatcgatcatgccgatggcgactacgctgacgagccgatgatttaccaggcgtttcagcctttgccgcgctttggcgatagctatacgctgattggcagttggatcattgacgatgaagcctccggaatggggattcgcgaggacaatacgctaattaccaaagacacttcccgtttcgtcccacattatattgccggttaatcatacttttgtgatcttgctccggcgtcaatggcgcagtcatgaccatacttgacttcagcgccattgaaggagggagacaccatgtcctggcaaacacataccgtctttaatcaacctgctccgctcaataacagtaacttattcctgtctgatggcgcgctgtgtgaagcggtttcccgggaaggcgcgggatgggatagcgatcttctcgccagcattggccaacaactgggaacggcggaatcactggaactggggcgtctggcgaacgcgcatcctcctgagttgctgcgttacgatccccagggacagcgcctggatgacgttcgctttcatcccgcctggcacctgttgatgcaggggctttgcgctaatagggtacattacctggcctgggaggaagaggcaagggcgggaagttttgtcgcccgggcggcgcgttttgtattacatgctcaggtagaagcgggaacactctgtcctgtcacgatgacctttgccgcgacgccgttgctattgcagatgcttcccgccactttccatgactggctggcgccgctgcgcagcgatcgctacgattcgcatttgctgccgggcgggcaaaaacggggcctgctcatcggcatgggaatgacggaaaagcagggcggatctgacgtactcagtaatacgacccacgcggagcggctggcggatgattcatatcggctggtgggacataaatggtttttctctgtgccgcaaagtgatgcgcacctcgtgctggcgcaggcaaaaggaggactatcctgtttctttgtgccgcgtttcctgccagacgggcaacggaactctgttcgtcttgagcgcctgaaagataaactcggtaatcgatctaatgccagcgccgaggtcgagtttcaggataccgtcggctggcggctgggagaagagggcgaagggattcggcatatcttaaagatgggcggtatgacgcgtcttgattgcgcgctcgggagtcatggcttaatgcggcgcgcattttcagtcgccatttactatgctcatcagcgtcaggcttttggtaagccgctgatcgaacaaccgttgatgcgacaaaccttaagtcgtatggcgctatgcctggaggggcagacggcgcttttgtttcggctggcgcgcgcctgggagcaacgtcgcgaggcgaaagaggcattatgggcgcgattattcacgccagcggcgaaattcgccatctgtaagcagggaatcccttttgtggctgaggcgatggaggttctcggcgggatggggtattgcgaagagagcgaactcccgcgcctgtaccgtgaaatgccggtgaacagtatctgggaaggttccggcaatatcatgtgtctggatgtacttcgggtgctgacaaaacaacacggcgtctatgacgtattgagtgaagcttttgcggaagtcaaaggtcaggatcgccattacgaccgcgcggtacgccagctacagcaacgtttacgcaaaccggacgaagcaatgggcagagagattacgcagcagcttttcttgctggggtgcggagcggaaatgctgcgtcatgcctcgccgccgctggcgcaagcgtggtgtcagatgatgctggatacacgcggcgaaatgccgctgcctgcccaggtgcaaaatgatttactgttaagggcgaccgggggactgcggtaacgtttggcctgtagtacatgccatccggcgcgagccacgcggcatcaggcatagagtatcgcctgtacgcgccagttattcgactgttgttcttcatacatttgaataattctgtaccaggacgcaccctgttcatcggctttgagggcgataatccgctccacatcctgtgggtttcctgcaacattactgaccgagatcaggccgatttcattcagacccgttacgcagtcagcactggcgaattcggcagactgtgccgtcgtactcaccagtccggcagaaagcagcagtgaggataaggcaagttcttgtttcatcgtcagctccttattacataccccgcatttaacaggacgctccatcacggtaaacctgtttgtttattgtgcacaggtaaacgcataggggcgcaaagcaatgtaaaactgactaaaaatcaatctactgttattgacgatataaaatggcttgtgaataccactgtccggttacaaccgtttcatcaaccattaagataacgtaataatcggctttcgcagcggcggctttcgctctgatttcatctattgcatcatccggggaaccccgaaccagcgcgcttacggtccccatccgctgtagtccttgcgtttgatcgcgacggatttcctgcgggtgatcggcgacaggcggcgcaggttgcggcgtaccctgcagtatgctacacgcgcttaataacagcgctgctatcaatggagcaaaccgacgcataactctatctcgtttcctgataatcatagtgtaatgccttattgatttccctttagggggaatgttcccgaagtgttacctgtcacgcgattttcgaatgaaaacgttgcgaaagcgtaacccagttctcaaacattatgaattattgcgctatccataaacttgcgttaagtatttctccgtggcataccggataaaaaggagagaataatgatagcgattgaaacacgacaattagccggaggcgtcgtactacatgccttcccggaagggaaacgcgccgtgccgcttccctgtgtggtgttctatcatggcttcacctcctccagcctggtttatagttattttgccgttgccctggcacaggcaggattccgggtagtcatgccggatgcgccggagcatggcgctcgcttcggcggcgactcacagggacggatacaccgattctggcagattctgcaccaaaacatgcaggaatttacgacgttacgtgcggcgattcaggcggaaaactggctacttgacgggcggttggcggtgggcggcgcatccatgggcggtatgacggcgctgggcattatgacgcgtcaccgtgaggtaaaatgcggggccagtttaatggggtcgggctattttaccgggcttgcccggacgcttttcccgccgttatccccgcagaacccggcacagcaggcggaattcgacaatatcatcgcgccgctacgtgaatgggaagtcacacatcagttagagcgactggccgacaggccgcttctgttgtggcatggtcaggaggatgacgtggtgcctgctatcgaaaccttccggctccagcaggcactcgccggggcgaagctggataagcatgtgacctgtttatgggccgcaggcgtgcggcatcgcattacgccagaagcgttgtcggcgacggtagcgtttttccgacagcatctttaaacgcggagtatgcttacaccctgggcttcaagctgttgcaaaacctgcggattggcatttttgccggtaatcagcatagcgatctgatcggctcggctgaacagcattcccgcgcgctcgccaattttactgctatcgaccagcgcgaccagtttcccgacgacgctgagcattttttgttccgccatggcggttagcatatcggtcttgtacaggccatccgcagttaagccctttccgctggtaaacatccagtggccagcatagagactgttttcacttccctgcgggctcagggtaatcgactggcttttgttgtactgaccccccatgataatcacgctgtcatgctcttgatcgatcagataattcgccagcggcagatagttggtaatgatctgtaccggcttcccgcacatttcgcgccccagcaggaaagcggtggagccgcagttaatcactacgctctcacccgggtttaccagctgcgacgccgctttcgcgatgcgtactttttcatcgtggttttgcgcctggtgcagattcatcggcgtccagcggggccgctgttgggtaatggcctctgcgccgttgcgcacttttttaagttttccgctttcgtcgagcttgttgatgtcgcggcgcgccgtcgccggggagattcccagacgctcaatcacgttttcgacggtaacaaagcccaactgtgccagcatatccagcagtatttgatgtctttgtgcttcagtcatgagctattccgatacaaattgatttgaaaagatgatatttgaaatagcctggaaatactaaagtaaatggaaaaaatgccgggtaatcccggcatgatatcgactcacaggaaggatttgaatggtagatcgggttcaatggtaaagcaatcgtcaaaaccacgcggatagtggtattcgaaattgtctttatccaacggccaggtaaacttgccgccaacctgccagataaacggtttaaaaccatacttcaggcgatctttcttcatttcccataacacgcggatctcctgtggatcggcctggaagttcgaccagatatcgtgatggaacgggatcaccactttggtgttcagcgactccgccatgcgtagaatatccgcgctggtcattttgtccgtaataccgcgcgggttttcgccataggaaccaagcgcgacatcaatttgatgttcgttgccgtgtttcgcgtaatagttggaatagtgagaatcgccgctgtgatagagattgccgcccggcgttttaaacagatagttaaccgcgcgtacatccatgccgtccggcagtacgccagcggctttctgatcggcgggcagggtgattaatgcggtgcggtcaaaggcatcaagcgcgtgaatttcaatatctttcacttttacgacatcgcccggttttaccacgatgcagcgttctttcggcacgccccagccaacccataaatccacgcaggtctgcgggccgataaacggaacatcatcggcgcaattctgcattacggcagccgcgacattgacgtcaatgtgatcgttatggtcgtgggtcgtcaggacggcgtcgatctgacggatagcgaaaggatcgagaacaaacggcgtggtgcgcaggttaggctgtaattttttgacgccagccatacgctgcatctggtgaccggttttcatcaacggattaccgtggctctgtttaccggtaccgcaccagaaatcgacgcatacgttagtgccgccttcagattttagccagatcccggtacagcccagccaccacatagcgaacgtacccggcgcgacctgctcttgttcaatctcttcgttcagccagcttccccactccggaaacgtgctcagaatccatgattcacgcgtgatgctttgtactttactcatcgcatttaccttcatgtttgttcaaaatggttcaaaacgtgatttgttttgattaatcctgacactattttctcaagaaggcaatgggctattttttgactttttggcaggagagaacgcagtcagaagaagatttaatcttgtctggcgtcatgtgaatgttggcatctttatgattttacttattttaatgaaaaaatgagttacctataagtaaaccatgtattaagtgtgctaattatttgcgcgctacgtcacatttaatcaaatttaatcttgttgtgattacttttgaaaattaaagtgaagggacattatcctgagcgcctgtgactcagcaaccttatctgccggagatcgttatggagatcctctacaacatctttaccattttctttaatcaggtaatgactaatgccccgctattactgggtattgtgacctgcctgggctatatcctgttgcgcaaaagcgtcagcgtgatcatcaaagggacgatcaaaaccatcattggcttcatgctgctacaggccgggtccggcattctgaccagcacctttaaaccggtggtggcgaaaatgtctgaggtctacggtatcaacggcgcgatttccgatacctatgcttcgatgatggcaacgatcgaacggatgggcgatgcgtatagttgggtaggctacgcggtgttgctcgcgctggcgctgaatatttgttacgtcttattgcgacgcattaccggtattcgcaccatcatgttgaccgggcacatcatgttccagcaggcggggctgattgcggtctctttctatatcttcggctattccatgtggaccaccattatctgcacggcgatactggtttccctgtactggggcatcacttccaacatgatgtataagcccacccaagaagtgacggacggctgcggtttctccattggtcaccagcagcagtttgcttcctggattgcctataaagtcgcgccgttcctgggcaaaaaagaggaaagcgttgaagacctcaaattgccgggctggctgaatatcttccacgacaacatcgtttctacggcgattgtaatgaccatcttctttggtgccattctgctctccttcggtatcgacaccgtgcaggcgatggcgggcaaagtgcactggacggtctacatcctgcaaaccggtttctcctttgcggtggcgatcttcatcatcactcagggcgtgcgcatgtttgtggcggaactctctgaagtgtttaacggtatctcccagcgcctgatcccaggtgcggttctggcgattgactgtgcggctatctatagcttcgcgccgaacgccgtagtctggggctttatgtggggcaccatcggtcagctgattgcggttggcatcctggttgcctgcggctcctcgatcctgattattcctggctttatcccgatgttcttctctaacgccactatcggcgtgttcgctaaccacttcggcggctggcgtgcggcgctgaaaatttgtctggtgatggggatgattgaaatctttggttgcgtctgggcggtgaaactcacggggatgagcgcctggatgggtatggcggactggtcgattctggcgccgccgatgatgcagggcttcttctccatcggtatcgcctttatggccgtcatcattgtaattgcactggcttatatgttcttcgctggccgcgcactgcgcgcagaagaagatgcagaaaaacaactggcagaacagtctgcttaataaggagttttgattatgaccgtacgtattctggctgtgtgtggcaacggacagggcagttccatgatcatgaaaatgaaagtggaccagttttaacccaatccaatatcgaccacacggtaaacagctgcgcggttggcgagtacaaaagcgagttgagcggcgcggatatcatcatcgcttccacacacattgcaggcgaaatcaccgtgacgggcaacaaatatgtggttggcgtgcgcaacatgctatcgcccgcagacttcggcccgaaattgctggaagtgatcaaagcgcattttccacaggacgtgaagtaaggacgcaacatgaaattacgtgattcgctggcggagaataattctatccgcttgcaggctgaagctaatacctggcaggaagccgtaaaaattggtgtggatttgctggtggcggcagacgttgtcgagccgcgttactaccaggcgattctcgatggcgtggaacagttcggcccttatttcgttatcgctccggggctggtaatgccgcacgggcgtccggaagagggcgtgaagaaaaccggtttctcactggtgacgctgaaaaagccgctggagttcaaccacgaagataacgacccggtcgatattctgatcactatggcggcggttgatgccaacactcaccaggaagtgggcatcatgcagatcgtcaacctgtttgaagacgaagccaattttgaccgtttacgcgcctgccgtaccgcgcaggaagtcctggatctcattgaccgcaccaacgcggcagcttaagaaggaattgaacatgtcattaccgatgttgcaagtcgcgctggacaaccagactatggatagcgcctacgaaaccactcgcctgattgccgaagaagtcgacattatcgaagtgggcaccattctgtgcgtgggcgaaggcgtgcgtgcggttcgcgatctgaaagcgctttacccgcacaaaatcgtgctggcagatgccaaaattgccgatgcgggcaaaatcctttctcgtatgtgcttcgaagccaacgcggactgggtgaccgtgatttgctgtgcggatatcaacaccgcgaaaggcgcgctggatgtggcaaaagagtttaacggcgacgtgcagattgaactgaccggttactggacctgggaacaggcgcagcagtggcgcgatgcgggcattcagcaagtggtttaccaccgcagctgcgacgcgcaggccgcaggcgtggcgtggggtgaagcggatattactgcgattaaacggctgtccgatatgggctttaaagtgaccgtgaccggcggactggcgctggaagacctgccgctgttcaaaggcattccgatccatgtctttattgctggccgcagcattcgcgatgctgaatcgccggtagaagccgcacggcagttcaaacgctccattgcccaactgtggggctaaggagcggctatgctgtcgaaacaaattccgctcggcatctatgaaaaagcgctccctgccggggagtgctggctggaacgcctgcggctggcgaaaacgctgggttttgacttcgttgaaatgtcggtggacgagaccgacgcccgactggcgcggctcgactggagtcgcgagcagcgcctggcgctggtgagcgcggttgctgaaaccggcgtgcgtgtgccgtccatgtgtctgagcgcgcatcgtcgttttccgctcggtagcgaagatgacgcggtacgggcgcaggggctggagattatgcgtaaagcgattcagtttgcgcaggacgtcgggattcgcgtcattcaactggcggggtacgacgtttactatcagcaggccaacgacgaaacgcgttgccgcttccgcgatgggttaaaagagagcgttgatatggccagccgcgcccaggtgacgctggcgatggagatcatggattacccattgatgaattccatcagtaaagcgctaggctatgctcactacctcaataacccgtgctttcagctctatccggatatcggcaatctgtctgcctgggataacgacgtacagatggagctacaggcgggaatcgggcatatcgtcgcggtacacgtcaaagatactaaacccggcgtgttcaaaaatgtgccgtttggcgaaggcgttgtcgatttcgaacgctgcttcgaaacgctcaaacagagtggctattgcgggccctatctgattgagatgtggagcgaaacagcagagaacccggcggcagaggtagcgaaagcgcgtgactgggtgaaagcgcgcatggccaaagcaggcatggtggaggcggcataatgcaaaagctcaagcagcaggtatttgacgctaacatggatttgccccgttatggactggtgacgtttacctggggcaacgtcagcgctatcgatcgcgaacgcgggctggtggtgattaagccaagcggtgtcgcctatgaaaccatgaaggtagatgacatggtggtggtggatatggatggcaaagtggtggagggtcgttatcgtccttcttccgataccgctacccatctggcgctgtatcaacgctatccgtcgcttggcggcgtcgttcatacccattcaacccacgccacggcatgggcgcaggcggggatggctattccagcgctcggtaccacgcacgcggactatttctttggcgatattccttgtaccagggcgttaagcgaagaagaagtgcagggcgagtacgagctgaacaccggcaaggtgatcatcgaaacgctgggcgaggtggaaccgctgcatacgccaggcattgtcgtgtatcaacacgggccgttcgcctgggggaaagatgcgcacgatgcggtacataacgcggtcgtcatggaagaagtggcgagaatggcgtggattgcgcgcggcattaaccctggcctcaaccccatcgacgattatctgatgaataaacacttcatgcgtaagcatggcccgaatgcgtattacgggcagaagtgaagtatgagctccggaatgtgaatattatcgggatgtcacaggtctaattccggagccatctttccgcgaaaaaagccccctgttcaggggggcaaatcaactatggctttttcgttggttttcctgatgttagcgataaatattcgcgctggcgtgtatgttgccgttgctacccggttcccggataagtatggcgtgataatacattgcgtttcgcgcgtcggcctcgtcattcagcgccagattggcttcgctttccgtggcgaagttatggttgatgtagatcacgcctaagctgcgcacatcatccatatttgtggcctggtgattatttaactcgatggctgccgttgccgttatgccaggcaaaagcgcagccagaaataacattatccgggctcgcatagagtacctcctcagcagcgcggtctggttggcgatatccccctttagtgaatcgcttctggtttaattttaaccataaccagccgcagagatggcgaccttttctgatgctgttgttcaaaaaattatcgcattgtcgttttttacctgattaacaacccgttgatgtatgccgctatgtttaagaaaccctgtgtggcaaaaaagtacgctgaccacagtgtcaatttttctgccgcaacaggccgtttatagtggcatgcgatatgaagttaatatctcagcagcaaaatgtgacgggacaggcgttacgttcggcacgataaataattgtacaatcaccttgagtttgcccgcaggcgccagtattataacgcgtcatttttcagccgacctttaacacgttccttgcctccatgggccgcggctgacccagacaggaggctgaataatccgtaaggagcaattcgatgcgtcattacgaaatcgtttttatggtccatcctgaccagagcgaacaggttccgggtatgatcgagcgttactctgctgccatcactggcgcagaaggcaagatccaccgtctggaagactggggccgccgtcagctggcttacccgatcaacaaactgcacaaagcgcactacgttctgatgaacgttgaagcgccgcaggaagtgatcgatgagctggaaactaccttccgcttcaacgatgccgttatccgcagcatggttatgcgtactaagcacgctgttaccgaagcatctccgatggttaaagcgaaagacgagcgccgtgagcgtcgcgatgatttcgctaacgaaaccgcagatgatgctgaagctggggattctgaagagtaatttctgatgaccaaccgtctgacgttgtccggcaccgtgtgcagggccccccttcgaaaggtcagtccatcaggaattccgcattgccagttcgtgcttgagcatcgttctgtgcaagaggaagccggctttcaccggcaggcgtggtgccaaatgcccgttattgttagcggacacgaaaaccaggccattactcacagtataacggtcggcagccgcataaccgttcaggggtttatttcttgccacaaggcaaagaacggtctgagcaaaatggttctgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtctctgctgccgtacactgatcgccatcagtaatcggtcacggtccattaatacgactttgagaggataaggtaatgcaagttattctgcttgataaagtagcaaacctgggtagcctgggtgatcaggttaacgttaaagcgggctatgctcgtaacttcctggtaccacagggtaaagctgttccggctaccaagaaaaacgttgaatacttcgaagcacgtcgcgctgaactggaagctaaactggctgacgttctggctgctgcaaatgcacgcgcagagaaaatcaacgccctggaaaccgttactatcgcgtctaaagcaggcgacgaaggtaaactgttcggttccatcggtactcgcgacatcgctgacgctgtgactgcagctggcgttgacgtggctaagagcgaagttcgtctgccgaacggcgttctgcgtaccactggcgaacacgaagtgaacttccaggttcacagcgaagtattcgcaaaagttatcatcaacgtggttgctgagtaatcagtcattctcgtttttgctagcaacgaaacgtcggcccagcgccggcgttttgcttttttaactccatcgcttttcgactggctatctccccctcttttcgcgataattaaaaataaaacattattttaatttcttggtgaaagaatggatacccaacgccaggcctccccgtttgcccgcaaaaacgtcgtttatgtgtgtgccgcattttgttgcctgctatggggcagcgcttatccagccatcaaaagcggttatgacctctttcagatagccaccgacgatatcccttctaaaattgtttttgctggttatcgttttttgtttgcgggtgggttgctactactgttcgcgctgcttcagcgtaaaccgattggtcggtttcgtccgcgccagtttgctcagttaacgttactaggtctgacccagacgtcgctgcaatatctctttttctatatcggccttgcgttcacctccggcgtgaaaggctcaatcatgaacgcgacaggcacattcttcagcgtattgctggcgcactttatttatcagaacgaccgattgagctacaacaaaacgctcggctgtattctgggctttgcgggcgtcatggtggtgaacgtcagcaacggcctggatttcagctttaatctgccgggagaaggctccgtggtgctggctgcgtttattctttctgcggccacattgtatggcaaacgtctctcgcagacggtcgatccgatggtcatgactggctatcaattggggattggcggtctggtactggtcattggcggttacgtttttggcggtacgctgacgatacatggcttctcgtcggtggcgattttagtctacctgacgctgctctcgtcggtcgcttttgcgctatggaacattttactcaaatataatcgcgtggggatgattgcgccgtttaactttctgatcccggtttctggcgcggctctttcggctatttttctcggcgagaatatattggagtggaaatacatgattgcgctggtgctggtgtgttcggggatttggtgggtgaataaggtgaagcggtaatgcttcacctgaacgaatagggtatagacggggtaaggcgcagccggcgttactgtgcgcgaataaaactgccgtcaggctgacgcgtaaacagcacctgttgaccgttatcgccatctatcgttaaacctgtcaccaccccgctggcattctggcgaattttaatcatttgaccatttttgaggttactcagcggcttgccagcgccttctacctgcgccattgcataaacgtctgtcgggggcagtccgtggtcacggaacagttgcgccagagttttaccaggctctacccggtacgagcgccattgttgaccgatgccgctatcctgctggaaaggctgcgtctgcggctggttttgttcttccggctggccttcctggataggttccgacgcaacgggcgccacctgatccggatcgttttgcggcgcgaccagttgcgcctgaagctgggcctccgtcggcggctgtgattgcgattgcagatccaattgcgcttcccgcgtgacgacaggcgagtcgctggtctcgctggcgggcagcaggaagccgatcaccagcacgatagcggcaatgataatgccacgacgatgcataggcggcagcggctccatgatgcgaaaattatccggcgcgtgccagattttcgccagggttggttttaattcaaagcgcccgggcatggtttacctcctgctccgcatctcgttccttaatcatagagtatagatggctaacgctatgatactggtagtgctatccgctttcgtgacatcaatacggataatctattgtttctttttccctgcgatttgtcatcctccctgagacaaagttttaccagaagaagcgtggctgttatgctgcccgctacttttttgatatccgatgaaggaaaaataatggccaccccgacttttgacactattgaagcgcaagcgagctacggcattggtttgcaggtagggcagcagctcagcgaatccggtcttgaagggctgttgcctgaagcgctggttgcaggcattgctgatgcgctggaaggtaaacacccggcggttcctgttgatgtggtgcatcgtgcgctgcgtgaaattcatgagcgtgcggacgcggtgcgtcgtgagcgtttcaaagcaatggcggccgaaggcgtgaaatacctggaagaaaaccgcgaaaaagacggtgtgaacagtactgaatctggtttacagttccgcgttctgacgcagggcgaaggcgcgattccggcgcgtaccgaccgcgtacgcgtgcattacaccggtaagcttattgatggcaccgtatttgacagctccgtcgcgcgcggcgaaccggctgaattcccggtaaatggcgtgatcgccggctggattgaagcgctgactctgatgccggtaggttccaaatgggaactgactattccacaggagctggcctatggcgagcgtggggccggggcatctattccgccattcagcaccctggtgtttgaggtggaactgctggaaattctgtaagcgccccgggtttgccggatgatggcgtaaacgccttatccggcaaccctgacttcagcagatgccaatattttattttgcaaatggcgtcgttacgtgtatttttgtgagataattcgcattatcaaagtgatataacactcattttaaacataaaattaacattgtatttgaatcttagtattcatcccgccgattcttacctaatatcgatgagtcctgataacaggatcgtcgtatcatagaccaaaggccgtagagcccgcacaacacagacaggtacaggaagaaaaacatggtagatcaggtaaaagtcgcagccgacgaacaggctccggctgaacagtcgctacggcgcaatcttacaaaccgtcatatacagcttatcgctattggcggcgctattggtaccggtctgtttatgggatcgggtaaaacgatcagtctcgccggaccgtcgatcatttttgtgtatatgatcatcggttttatgctttttttcgtgatgcgcgccatgggggaattgctgctctcgaatctggaatataaatcgtttagcgattttgcttccgacctgcttggcccctgggcgggatatttcaccggctggacgtactggttttgctgggtagtgaccggtatggctgacgtggtggcgattaccgcctacgcgcagttctggtttcccggcctttccgattgggtcgcctcgctggcggtagtggtcctgctgctaagcctcaacctcgccaccgttaaaatgtttggtgaaatggaattttggtttgctatggtcaaaatcgtcgccatcgtggcgttgattgtggttgggttggtgatgattgcgatgcactttaaatcgccgaccggcgttgaagcgtctttcgcgcatctgtggaatgacggcggctggttcccgaaaggtattagcgggttctttgccggtttccagattgcggtgttcgccttcgtgggcattgagctggtcggtactaccgccgcagaaactaaagatccggaaaaatcgctgccgcgcgcgatcaactcaataccgatccgtatcatcatgttctacgtctttgcgctgattgtcattatgtcggtaacgccgtggagttcagtcgtaccggataagagcccgtttgttgagctgtttgtactggtgggtctgcctgccgccgcgagcgtgatcaactttgttgtgctgacctcggcggcgtcttccgccaacagcggcgtcttctcgaccagccgtatgctgtttggcctggcgcaagaaggcgtggcgccaaaagcgttcgctaagctatcgaaacgcgcggtaccggcgaaaggcctgaccttctcctgtatctgcctgctgggcggcgtggttatgctgatggtcaacccgagcgtgattggcgcattcaccatgatcactacggtttcggccatcctgtttatgtttgtctggaccatcattctgtgttcatacctggtgtaccgcaaaaagcgtccccacctgcatgaaaaatccatctataagatgccgctcggtaagctgatgtgctgggtctgcatggcgttctttgcgttcgtgctggtattgctgacgctggaagatgatacgcgccaggcgctgatcgtgacgccgctgtggtttatcgcgttgggtctgggctggctgttcctgcgtaagaacaaactggctaaatgacggatttatccctctcgcttaggcgagggggtatgcgcataacgtacccgccggggcgctttcttcatttttacgccccattttgtcgcttcccgctccttaacgagctatttttctcgccacatttgatagcgtatggagatgaaaagctcaggaaatgagtgtttgtccgctgatgcaatgacgcgaaaaacgtttcttcaggaagggcagctgtaaattgcaggctgacggtaagtgccgccttgatgaattcctataatggcggctcgcgctggataatacgttgaaaaagtggtttaagtaacaaattaatctcctatttcaaactgtaattatgaccattcgacgctggattttaagcgctacgcttttgctgctgcccgttcccgcgttcgcagattttcagtatcagcaggataaggacggcgttttttataccgccgacgacgaaccgcaaattctctcccgactgcctgacgttagctattcgcatttacggcgtattgccgatttatctcacccgcaagaccctcgcccgttaatagaaatcaatcccgacagccataactgcgacgacaatcatatttgtcagcacgcttatctcagcgatgggcactttatcctgtgggcaggcaaaatcgtccagaataccggggatgagcctgccgttgatgttgccagctttcagtcttttggcgcctttgccgccgataaacacggtctctattttgatggtaaacgtcgtgatagcaatgcgggtgaaaaacgtgtggatatggcaactctggcagagacgaaaatctggaatctgctgcgggataaaaataatctctattatgaaggccgctggctggggcgggccgatgggtttcgcgtgttgaggctggattccacttcggcaagggagtttattgtgacgacggcgcaacgggtgattgtgaacggcatacccattaccgctgatgctaatacgtttcaaatcattcgctggatgcctggcgaggtactaatttatcgtgataaaaccggtaagcatgactatgagattgataattccagtcggtactgcggctattttaatattggcctgcgtgaggtgacatggctgaagcatgaggcaaccaacgccgggagcagttgtaaagtggaaaccctgccgggtgtcgatccggagtatttttttcgtctgaatgggaacaccggttggtataaggatcgtatttatcaggtgagcacgaatgcgttgggcgagggggtgctgcgcatttttacgtcgcaggaaaaacttccggcgctgaaaatagatagagttacctataattactaccatctggctttgtccgcggatgggcaattatatcgccagatctcacgtgatcaatggcagagctataacccgatattaacagagtggacgacggtatcaccagcgcccactgacgttatctctttgcttccctctgattaccactagcgcaggatggcgcaatgttgagaataaaacagttctgtttatcgattttattaatgctggcaccagtgttagctctggcctgttccgacattccatatgctttgtttcactatcagccgtgggggcagggaacgaaatatgtagttgaagaagattatggttatagtattaattttaaagatattgaaattcgagaggtaaaatttagtcaactacggcacgttcctgaccgcattgttaatgaatataatgaccgtggaaaaatgagtaatgattttgttcatgtcgccgctttttcatcgctaataaaaaatgatttctggcagttttattggctaaccgacggccagcatattttatgggctgggaaaatcgtacaaaatccaccgggtaagccgccagtggatgcagcgacttttcgggcgtatggacgctttgccgctgataaagatagtctttacttcgacggcgagcgcacagatgataatcatggtgaaaaaagggtcgatatggattcgttgcagcaggtcggcggcaacatcaaattacgcgactccggcgatgtgcttaaagacaggcgcaacctctactttcagggacgctggctggctagtgcgcagggatattccatcctgggcgttaaatcctgggagcagcgtaatattctgttttcgccgaccagctgcgatactacatctaatcctggcccgtgggacactattctgcgtaccgccacgcaggtttttgttaatggtgtggcaattgatgccgatccgaactcttttcatgttgtgcgctgggtcgctggcgtgcagttactctatcgcgacaaagcaggcgtaaaacgctattacttcggcaaagactgtctcaatacgtttaatgtacagcgggataaggtgacatggatgacgcgagaggcatcgcgccgaggcgatgactgccgaatagcgactattcccaatgttgatccagaatatttccatcccattcattacaattggacggtagcacagtacaaagatctattgtaccaggtgaagtatgtctctccggtcgacagggtattaaccatcacccgcttgcctgatccgcaggtacagctgaaagctggcgctaatttggtgggtaaacagatctattttatcggcgatgggggagtgcagattatcgaccttattggaccattggtgtggtttaaaagtcccgatggttcattttctgatgtttttgctcatgacgatcgttatctctatttcttcggtgatacgctggtagatagcgggcaacggcgtaacgtaacgcggacgctggatactgcgcatatcgacaagagcggttattatctggtcactgaggaggggaaatatgaggttattaataatgcattcacctctcgctaaaaagcgttagtcgattcagaataaacgatcctgtctatgcgttcaggatcgtttattggcgatggattattccccggccagcgcgcgtgggaacagcacgttattctccaggctgatgtgctccatcagagcatcaatcatctcattaatgccgttatacatcgctttccaggtggtgcaggcttctggcggcggcgttacattttgggtgacgtgtttgatgacgtctaccagctctcccgcctcgtcatgctcgctttccattacgcttatcgggcccgttgcctggcgacccataccctgtttgatcatggggaacaggatctgttcttctttcatcatatggctggaaagctcttcatgcagcgcggtgagatattttgtcaggccgcgtgggacgtttggcttatccgcgtgaacgcgttccactttggttgcctgcaggataagctccggcagttgttcgcggtgtcggtcatgatagcgcacaacgatatggtcaataatgtccgtcagcggaacggcgcgccagtctttttcgatgggctgttcagccaactgcgcgagttgcgcttcaataatgtcaatatcgacgtcgtgacgagcggcggcgcgcgccagcgtctgttttccgccgcagcagtaatccatatcgtactggcgaaacagcgccgatgcgcggggaatagagagcgccagttcgcctaaaggttgatcgcgataagccatagccgttacctcatttgcaataatataagttgtattttaaatgcatctttaaggcgaggctataactctttcggggtgcgtataatttaagccaggatgagattagcgttccgtgaccggaacgacggtcgctttttccggtttcgctctcacggcaataaccacgcccgccaccaggagcgcaatgccgcttaacgtcaggaatggcgggatttcctggcgcagaatgaaggtatagagcagtcctgccaacgtttcaaaaacaatcagcggccctaaaatcacggttggcaatttttggctggcgatattccagcacaacgcgcccacccaggaacacagcaccgcgatggcgatcatcagaccgataaacagcgcgggatgcgggccaaagggcagggtaaacatcgggttctggatactcagccacagacaggttgccgcatagccgattaacgagaccggcagcgtaaccagcgcctgcgccgttgcccacatcatgggatgtttgtcgggatttttccgcagccagcgggcgttgcgcagcgcataccatgcccagcacgctacggaaatcagcgccagcacaatgcctgaaccatagcgccagccgctaacatcggacaatccctggctaagttcagcaatattgacgcacagcaggccaaaaccgataagcgccagcgcgggcgctaaacgtagccaggataatctgccgtctcgttggctatagagaacgttagcgaaaagcggaatgacgaccggcaatgtcccgatgatcatcgtcgaaaccggcgcgccggttcgctgaatggcgctggcgaggcaggcgtaatagattacattgcccatcagggtcagcgacagggcggtggaccagtctttgcgcgtcaactggcgtaaccgcgtgcggcctaaccaggcaatcggcagggcaatcagccccagcgccagatagcgtcccattgactgtaagagggccgggtaatccggcacgattaacgggccgacgaaaatcaatccccacattagccctgccagcagggcgtatagcacgccgctaatcatcagattctcctcataaaccgttccgtcattatcagagaaggtctatgaggatgccatataaattaactaaattttaacacttacagtacggagcgaaggctttctgtgagcgccgtcgtcgggcgaccgatgagtttacgcagcgtatggctgtcatcaaacagaccgcctttcgccgcgccagcgtcagaattggccaacatatccgccagtccgtcaggcaggcctgcgcctttcagcgcggcggcaaaatcgacttcgctcaggttctggtagacgattttttttccgctctgatgagtaagttcatccgccaactggcttaatgtccaggcgttatcacccgccagctcgtaaacattcccggcgtgaccctcttcacggatgacgcgcgcggcggcggcggcatagtcagcgcgcattgcggaggcgattttcccttctcccgccgcgccaataaagacgccatgcttcagcgcggcagggacgctcgccaggtagttttccgtataccagccgttacgtaatagcgtgtgaggaatacctgactcagccagcatcttttccgtttcaatatgttcatcggcgagcgccagcggcgatttatccgcatgtagcaggctggtataggcgatgaatttcaccttcgcggcaatgacggcctgaatgacgttgcggtgctgcgcggtgcgttgtcccacttcgctggatgaaatgagcagcagtttatcaacgccctgtaaggcggtggtcagcgcagcttcgttagcgtaatccgcctggcgaacggcaatcccgcgctgactgagcggggcggcttttttcgggttacggacgatcgcgacaaggtgactggcgggcgtcgtttttagcaggttttcaataacgtgttggcccagttggcctgttgcgccagtgatagcaatcatggtgaactcctcagtgttggtcttgtgttttattacgctaccacctaaacttacttttagtaagtacgtacaaaaaggtaagtatcaatgcgcgctcatactctttcccggcagttgcgtgaaggtaatctctttgctgaacagtgcccgtcccgtgaggtgttaaaacatgtcaccagtcgctggggcgtactgattctggtcgcgttacgcgacggtacacaccgttttagcgacctgcgccgcaagatgggaggcgtgagtgaaaagatgctggcgcagtcgttacaggcgcttgaacaggacggatttcttaaccgggtgtcatatccagttgttccgccgcatgtggagtacagcctgacgccgcttggcgagcaggtgagtgataaagtcgccgcgctggcggactggatagaactgaatttgccccaggtattggcgcagcgggagcgtttatcagatggcggctagcgctttattcggcctgccagtcaggccgaataaacgcagcgccatacgggactcacgttacttgctcaaatccacctgataaatggcaaaaccgatatcatcgacaccaacctttttcatcggatactgccctttctctttaatgaaggccgcggctttatcgcctggcgatgtttcaaagcggatatccagcgccgtatcgctgtggattggcgccagacgccagttattatccgccgccggatggatttcgcccgcgcgttttgactctgcgccaatccatgccgccagcacggcgcgattttcatccggagacgcaaaggcgatatggctgtcgcccgtgccggcaaacttgccgccgtaagcgcgatagttattcgtggcgaccaggaacgtagcgttcgggtcgacaggcttaccgttaaaggtcaggtttttaatacgttccgcctgcggattcaccatctggcattcgccatcatagcgggcgggctgtgacacatcgatttgataattcacaccgtcaatgacatcgaaattataggtgcgaaagccatcccaattgatcaacgattgcggtttgttgctgtgaatatcaatctgattaaactgtccggcagaacattccagccactcttttacctccttgccgctggctttcaccaccaccagcgtattcggatagagataaagatccgcggcgttacggaaggtcagctggcctttttccacctcgacaaagctggcaggatcgttcttacgcccgccaactttaaacggcgcggcggcggacagcaccggcagtttcgccagatccggatcgccctgaataaagtgttccacatacgctttttgcgcgttattcaccacctgtacggtaggatcgtcctgcaccagagcaagataactgtacatattatcggcggatttaccgatgggcttgctgacaaactcgcgggtggcatcgtgatcggctttcagaataccgaccagcttactgtcttccgccgccagcgactttttagcggcggcgtcgtaaataggccgcgcttccgctttcgcctgcgtaacctgccatttgccgctgtcgttattgagcaccagatcgaccactcccagatggtcgccccacatgcctggcattaccgcaggaatgccgttaagcgtacatttggcgatatccgcgcctttgatgtcggcaaaatctttaccggggaagacggcgtgggcgtgaccaaacataatcgcgtcgacgccgggaacttcgctgaggtaataaaccgagttttccgccatgctgtggtacggatcggcagaaaggcctgagtgagcaatgactaccacgatatcagcgcctttctcgcgcatttcgggcacatatttccgggcggtttccgtaatgtcattgacggtaactttgccgctcagattcgctttatcccaaatcatgatttgcggcggaacaaagccgatatagccgattttcagagtgtgcgggtggccgtctttatcaataacgctcgtctctttaatcagataaggcgtaaagagcggcttttgggttttaacgtcgataatattggcgttaacataagggaatttcgcgccggccagcgcgttatgcagatagtccagaccataattaaactcatggttgccgaggtttccaaccgcgtaatccagagtattgagcgctttatagaccgggtgaacatcaccgtctttgagcccttttgccgccatataatcgcccagagggctcccctgaatcaggtcgccgttatccaccagcacgctgtttttgacttcatttcgggcggcatgaatcaaacttgcggtacgtactaatccgaatttttcggttgcggtatccttgtaataatcgaaatccatcatgttgctatgtaaatcagtagtttccatgatacggagatcgacggtggccgcattcacgctggcggcgatcagcgtagccagaagcgttgcactaaacttaatcatcagaggcaccttttaagaacgcaatagaaaagccggatagtgaaaaatagcgatgataaacagtgaaaccggtatcgttccgaccgtcgccagaagaaggcgaaaccgccccatccggccgattttttgcgagtgttcacagaaaggtgaatcatgccatgaaagctattatcaaaaccgctgacggtatcacagttggcggaacccttaacgatcgggtataagtaaaacaacgagttaacgcccccgtcataaagaggtggagaatgttagaacaagtatgccagcttgcacggaacgcgggcgatgccattatgcaggtttatgatggagccaaaccgatggagtacgcccgcaagcaggacgattctccagtcactgcggcggatatcgccgcacataccgtgattctcgaagggttacgcacgctcacgccggatattccggtgctttcagaagaagatccgcccgcctgggaagtgcgccagcactggcagcgttactggctggtcgatccgctcgacggcaccaaagaattcatcaagcgcaatggagaattcacggtcaatatcgcgctgattgagcagggcaagccggtgttgggcgttgtctatgcgccggtgctgaaagtgatgtactacgcggcggaaggtaaggcctggaaagaggagtgcggggtgcgtaagcagattcaggtgcgggatgcccgcccgccgctggtggtgattagccgttcgcatacggatgatgaactcaccgaatatctccaacagcttggcgaacatcagactacctctattggttcctcgctgaaattctgtcttgtggcggaaggacaggcgcagctttaccccagatttgggccgaccagcgtctgggatactgccgcaggtcatgccattgccgttgcagccggggcgcacgttcacgactggcagggaaaaacgctggactatacccctcgtgaatcgttccttaaccccggcttccgggtgactatttactgaggagcttatgcagcaggtcgaccacctgctgtacctcttgctgggttaacgcgccatctttcacccattgaacccgaccgtctttgtcaagcacgatgacggcggacccctcttcttttaattgccaggcgttacgcgccacgccattgctgtcgacaataaattgcgaccacgggtagagctttttattactttctatactgctacgcacgaacataccggagcctgggattgcatcatcggtgttcacaattgtggtcgtctggtatctgtcatgcgggagcttggctgatttaatcgcttcaatcagcgtggcgtttttttccttcgctgacgttcgacccgcaatgtgcagcaggacgcgcacttttcccgccagctgcgcgctattccagtttttataactaaactcatctttattcaacgtcagttcgccacgatcggcaatgcctaccggcggcacccgttggttatcttcaaggttatgcgcacaagccattatggggagtagcagacacgacatcgccagaattttacgtagggtcatggtcattccttctttatttttttgcaggtgatccgaccactttgggccgacagttaatcatatgtgcgattgatgctttttcccgcaaaggggatgccagtttgcgggcgggtgcacacttcctgtgaaaaatgaaggcatatactgagaaaaatgagctgatgtttagataattctgaataactgtaatcaaaaggtaaatatacttatgcacactggaaacgacgtagatatggtctatagtcatatggcattaaaatttgcgccttaaaactgttgggccgattgtggcaccgcaagggcgtaatactctgcaggagacaacaatgaaaattttccaacgctacaacccgctacaggtggcgaagtacgtgaagatcctgttccgtggacggttatatatcaaggatgttggcgcttttgagttcgataagggtaagattcttatcccaaaagtgagagacaagcagcacttgtctgtgatgtctgaagttaaccgtcaggttatgcgtctgcaaactgagatggcgtaaccaaaagtgctatgcagtaggttaaaaaagtaaaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacataattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaacaaaaaaacggctcctgaatcaggagccgttgatgtttctggcaaacggatttcaggccgcgctgtcttctttaccttgcgcatcgggcagtttcggcgccggtacgttgcttttattgtcgagacgcgtcaccagcaactgatcgatacggtagttgtcgatatccaccacttcaaatttgtagccggaaaacttcaccgaatcagtacgttttgggatcttgcgcagcataaacatcataaagccgccaatggtttcatagttgccggattgcggaaactcatcgatatccagcacgcgcatgacgtcgtcaatcggcgtgccgccgtcaaccagccaggaattttcatcgcgcgccacaatttgctcttccagtccctggccgaccaggtcacccattagcgtggtcatcacatcgttcagcgtaatgataccgacgaccagcgcgtattcattcataatgaccgcgaaatcttcgcccgccgttttgaaactttccagcgcctcagaaagggtcagcgtatccggcacaatcaaggtattgcgaatttgcacgccgctattcagcgccatactttggttcgccagcacgcggttcagcagatctttggaatctacatagccgatgatgtggtcgatatcttcattacacaccaaaaattttgagtgcggatgttcggctacctttttcttcaggctttgttcgtcttcgtgtagatcaaaccagatgatactttcgcgcgacgtcatagaagacggtacggtgcgggattcaagttcaaacacattttcaatcagttcgtgctcttgcttgcgcaagacgcccgccagcgcgccggcttccaccaccgcgtaaatatcatcagaagtaatgtcgtctttccgcaccattggaattttgaacaggcggaagatgttgtttgccatgccgttaaacagccacaccagcgggcgaaaaacgaacaggcagaagcgcatcgggttgatgatacgcaaagccacagcttctggcgcaatcataccgatgcgtttcggggttaaatccgcgaacaggataaacagccccgtcaccagcgagaaagagagaataaagctcaactgctcggagagttctggcgacatatagtgcgagaaaagggcggaaaaggcgggcgaaaatgccgcatcgccgacgataccgccaagaatagcgacggcgttcaggccaatttgcacaacggtgaaaaacatgccgggattttcctgcattttcaatacgcgttgtgcgttgatactgccttcatcagctaataacttaagtttaatcttacgtgatgcggcaagcgagatctcggagatggagaagaacgcacttacagcgatcaggcagaatataatgaatatactgtttaacatatcttatccggcgaaacgccagatcctcggaagggaagtttataaatccgtgtggtaacgtttaatgaaaaccggctcgtagcagtgagccgataagttcagggctagtatagcgtaagctactgtaaagtcgccagagggttcattttcaactccgacaagttccccctacgcctgcgtcgtcacgcgtcacgcgtcaggcggcaggcaaacgccgatcccgccaatcccgcagtaaccgtatggatttttgtgcagatactgttggtgttcatcctcggcgtagtaaaacggcgtcgcatgggcgatttccgtggtaatagggcgatggtctccggcggcggccattgccgactgaaagcgctcgcgactggcgtgagcggcggcattctgttccggcgttaagggataaatcgcagaacggtattgcgtaccgtgatcgttaccctgttgcatcccctgcgtcggatcgtgattttcccagaaggtctgtaaaagctgctcataacggataacggcaggatcgtacactatccgtaccgcttcggcatgaccggtctgcccggagcagacttcccggtaggttggattaggcgtgtaaccgcccgcataccctgctgcggtgctatatacgccgggcaattgccagaataaacgttctacgccccagaaacagcccatcgcgaagtaggcgatctccatcccggcagggacattggtcatagagtgttcatttaccgcatgcagagtggcgattggcatcggggtgttgcgtcctggtaacgcatctgcttgagtaaccagatgttttttatcaaataaactcatgaactattctcccgaaagcgttaattggcgttaaggttgtaacgagacgcatctttgcacacaataacaacattaatgtatctggatttaaccataagaaatatttgggcagtcgtctgcttttcaatcgaaattgttgattttatgttaagccgcggagcggtagtgtgattttttccaggggtgggaataggggatattcaggagaaaatgtgccacatatccgtcagttatgttgggttagcttactgtgcctgagcagttctgcggtagccgcaaatgttcgtctgaaagtcgaagggctatccggagagctggaaaaaaacgttcgcgcacagctctctacgattcagagcgatgaggtgacgccggatcggcgctttcgcgcccgagttgatgatgcgattcgcgaagggcttaaagcgttaggctattacgaacccactatcaaattcgacttgcttccaccgcctgcgaaaggacggcaggtattaatcgccagggttacgcccggccagccggtgttgattggcggtacagaagtcattttacgcggcggcgcgcgtacggacaaagattatctggccttactgaaaacgcgtccggcaatcggcacggtgctcaaccagggggactatgacaattttaaaaagtcgttaaccagcgtgtcgctacgcaaaggctatttcgacagcgaattcattaaaagtcagttgggaattgctctgggccgtcatcaggcgttttgggatattgattatgatagcggtgagcgctatcgcttcgggcctgtcaccttcgaaggttcgcagattcgtgatgaatatttacaaaatctgttgccgtttaaagagggtgatgagtacgaatcgaaagatttggcggaactaaaccgccggctttccgctaccggatggtttaattctgttgtggtggcgccggaatttgagaaatcgcgtaaaacaaaaattctgccgttaaaaggcgtggtatcaccgcgaaccgaaaacacgattgaaaccggggtggggtactccaccgacgtcgggccgcgcgtgaaagcgtcgtggaaaaaaccgtggatgaactcctacggtcatagcctgaccaccagcaccagtatttctgcgccggaacaggtgctggattttagttataaaatgccgctgctgaaaaacccgctggagcaatactatctggtacagggcggttttaaacgtaccgatttgaatgatacggagcaggactcgaccacgcttgccgtgtcgcgttactgggacctttccagcggttggcagcgggcgattaacctgcgctggagtttcgaccactttacccaggggaacgtcaccaataccaccatgctgttctacccgggcgtgatgatcagccgaacccgctcgcgagggggactgatgccaacctggggcgattcgcagcgctactcggtagactattcgaatacggcctggggctccgacgtggatttctccgtactgcaggcgcaaaacgtctggattcggactttgtacgatcgccaccgttttgtgatgcgcgccaatttgggctggatagaaaccggtgatttcgacaaagttccgccggatttacgtttcttcgccgggggcgaccgcagtattcgcggctataaatacaaatctatttcgcctaaagatagcgacggcaatcttaaaggtgcctcaaaactggcaaccggatcgctggagtaccagtataacgtcaccggcaaatggtggggggcggtgtttgtcgatagcggcgaggcggttagtgatattcgccgtagcgatttcaaaaccgggaccggggtcggcgtgcgctgggcgtcgccggttgggcctgtcaaactcgattttgccgtaccggtcggcgacaaagacgaacacggtttacagttttatatcggtctggggcctgaattatgagtttatggaagaaaataagcctcggcgtgttgattttcattgtggtgttactggcgagcgttgcgtttctggtcgggacgacgacggggctgcatctggtattcggtgcggcgaaccgctgggtgccggggctggatattgggcaggtcaccggcggctggcgggacttatcgttaaaaaatatccgctatgagcagccgggcgttgcggtaaatgcgggcgaaattcatctggccgtcgggcttgattgcctgtggcgcagtagcctgtgcgtcaatgatctggcgctaaaagacattaatgtcgctatcgacagcaaaaaaatgcctccttccgaaccggcgcaagaagaggaagaaagcgggccgctgaacctctccacgccctggcccatcacgctgtcgcgcgtggcgctgaataacatcaatatcaagattgatgacactaccgtttcggtgctggattttacctacgggctggcatggcaggagaaaaacctgaccctgaaaccgacgcggcttcagggactgctgatcgcgctgccgaaggtcgctgaggtggcgcaggaagaggtggttgaacccaaaatcgagaaacctcaaccggatgaaaagccgcttggcgaaacgctaaaagatctgtttgcaaaaccggtaatgccggagatgaccgatgttcacctgccgctcaatctgaatatcgagtcatttcgcggcgagcagctacgcatcaccggcgataccgatctgacggtgcgcacgatgctgcttaaagtcagcagtatcgacggtaatatgaagctggatactctggatatcgacgccaaccagggcacggtgaaagcctccggtacggcgcagctcgccaataactggccggttgatattacgctcaacagtacgctgaatatcgatccgctaaagggtgaaaagatcaaactcaaggtcggcggcgcgttacgcgaacaactggaggtcagggtgaacctttccgggccgatggatgtcgcgcttcgcgcccagacgcggctggcggaggccggtttaccgctcaatcttgaggtcgtcagccaacgcattgcctggccattgacgggtgatacccagtttcaggctgacgatctgaagctcaaactgagcggtaagatgaccgactatacgttgtcgatgcgaaccgccgtgaaaggacaagatattccgccggcgaccatcacgctggatgctaaagggaatgagcggcagattaatctcgataaactcaccgtcgccgctctggagggaaaaaccgaactgaaagcgctggtggactggcagcaggcgattagctggcgtggcgaactgacgctgaatggcatcaataccgctaaagagatcccggactggcccgcgaaacttaacggcgtcatgaaaaccaaaggcagcctctacggcggcacctggcagatggatgtcccggagctcaagctgaccggtaatgtgaagcagaacagcgttaacgtcaacgggacgctaaagggcaacagctacatgcagtggacgatcccggggctgcaccttgcgctgggcccaaacagcgccgatataaaaggcgagcttggcgttaaggagctgaatcttgacgccgccatcgatgcgccagggctggataatgcgctgccagggctgggcggcatggcaaaaggaatcgttaaagtccgcggtacggtagaagcgccgcagctgttggcggatatcaccgcccacggtctgcgctggcaggagctgtctatcgcccaggcgcgcatcgagggcgatattaaatccaccgatcagatagcgggccatctcaacgttcgcgtagagcggatttcgcagcccgacgttaacatcaatctggtgacgcttgacgccaaaggcagcgagaagcagcatcagctacagctccgtgttcagggagaaccggtatccggtcaactctccctgacaggcagttttgatcgcgaggaggcgcgctggaaagggacgttaagcgacacccgtttccagacgccagtggggccatggtcgttgacccgcgcgattgcgctggactaccgtaataaagaacaggaaatcagtatcgggccacattgttggctgaacccgaacgccgagctgtgcatcccgcaaaccattgatgcgggcgccgcaggacgggcgttggtcaatctcaaccgctttgatctggcgatgctgaagccatttatgcctgataccactcaggccagcggggtctttagcgggaaagcggacgtgtcgtgggacaccacccaggagggattgccgcaggggaaggtcacactttccggtcgtaacgtgaaggtcacgcagaccgtcaatgacgcgccgttaccggtcgcgtttgagacgctgaacctcagcgccgatctgcacaataatcgcgccgagctgggatggctgattcgcctgacgaacaatggtcaattcgatggccaggtgcaggtaaccgatcctcaggggcggcgcaatctcggcggtaacgtcaacatgcgcaatctcaatctggcgatggtcaaccctgtctttttgcgcggcgaaaaagcggcgggaatgttaaacgccaggctacgtctgggcggcgatgtgcaaagcccgcagttgtttggtcagttgcagcttagcgcgctggatattgacggtaattttatgccgtttgagatgcagccgagccagctcgccatgaactttagcggtacgcgctcgacgctcgctggtatcgtgcgaacacaacaagggcaaattaacctgaacggtaacgccgactggagccagattgacaactggcgcgcgcgggtgacggcgaaaggcagtcgggtgcggattaccgttccgccgatggtgcgcctggatgtctcgccggatgtggtctttgacgcgacgccttcgctgttcacgttggatgggcgtgtggacgttccgtgggcacgaattgtggtgcacgacctgccggagagcgcggtcggcgtctccagcgatgtggttatgctcaataatgacctgcaaccagaaacgccgcagacagcatctattcccatcaacagtaatctgacggtacatgtcggcaacaacgtgcgcatcgacgccttcgggcttaaagcgcgtttgaccggcgatttgaaagtcgcgcaggataagcaggggctggggctaaatggtcaaatcaatattcctgacggccgattccgcgcctacggccaggacctgcttgttcgtaaaggcgagctgctgttctccggcccgccggatcagccgctgctcaatatcgaagcgatccgtaaccctgacgtcaccgaagacgatgtcattgcgggcgtgcgcgtcacaggcacagctgatgaacccaaagcggaaatcttctccgatccggcgatgccgcaggctgaagcgctttcttatctgctgcgtgggcaggggttggacagcaatcagagtgatagcgcagcaatgacttccatgcttattggcctgggggttgcgcaaagtggtcaggttgtgggtaaaatcggagagacattcggtgtaagtaatctggcgctggacacgcaaggggtgggcgattcgtcccaggttgtggtcagcggctatgtactgccgggtctacaggtgaagtatggtgtagggatatttgactctctggcgacgctcacgttacgttatcgcctgatgcctaagctatatctggaagcagtgtctggcgtagatcaggcacttgatttgctctatcagtttgagttttagcaatgcgaatatttgtctatggcagtttacgacagaaacaaggcaacagtcactggatgaccaatgcccaattgcttggcgattaccgtatcgataactaccagttgtatagtctgggccactatccaggcgcagttccgggaaacggagcggtatacggtgaagtttatcgaattgataacgccacgctggccgaacttgatgctttgcgcaccaggggcggtgaatacgcacgccagttaatccagacgccttacggcagcgcatggatgtatgtatatcaacgtcctgttgatgggttaactctgattgaaagcggtgactggttagacagaaaccagccctgaactgaacacgccaccctcgggtggcgttgttttttacattctggctgatggcgttaacgccgggcatggtgagctcttattctgccgtagatcaataatgacgcgccgcccaggataacaatgcatccgagaaccataaatccctgcatatagctgccggttgtccggtaaaaatagccgaccattaggcctgccaacgtaccgccgccgccggcgccgatgccattaataataccggaggctgggccaatcgcatggggtttaacgttcgactggataatcgaccagatattgggggtaaagctggcggcataataacccatcgccagggtaatgagcgtgattttaaagcccggcgcatcgacaaatggcaggagaaataacatcacgccggggattagtaggcccagtgaagcaataagtacacgtttttgtgtcttatcactgatccatgagatggggattgccagtataaccgcagtcagataaggcagagaactgaccaatgctttactgaatccggtatagccgagagaattgacaaccatggggatccataacgtaattccccagaacaacatcccttgagtgatgtaggtaaaaataaggagtaggaagggggttccgcccagcgattccagagtaagtttagttttctctgttggcgccggcgcacgataataaggcgcttcttcctgttttttcagcattgttatataaagtggaaccacaacaacaatgccgatcataccagtgataataaaaacatttcgccaaccgaaggcagcatccagcggggacaaaatcataaatcccaggcctaatgccaggaactgtccataatactggataatgctgttcgcctgcgtccgttctttgtctgaaaaccagtcgctggcgaagcgggactgctgcggccaataaatgccttcggtaatgccaagcaccagccgacaaatcaaaataacgtacactgacgaggtaaatccgacaaaaacggtcgcaatcgaccagattagcaccatcagaatgactatttttttcggatcgtatcgctgggtaaatacgccgccaaaaatatttgaaaaggcatagccaataagaaatatggttaatacaatgctggccgttgcgccatcaatattcaggtcgtgtgtaatcgtaggtaacgtaacggaaagattagaacggtcaagataagcaacaaaaaggccgaacattaatgtcgcgccgatccgtagccatttttgcattgaggtcatttttcaactccgtttggccgcgtgccaaaatcaatttgacgaaataatatctcaccggattttatggtcatttgtggtaccagcacatgcgtccccgtgagcgtttcaccatgaatatcggcaaattcaacatgcctgttttttaatttaaagatggcgatatcggcaaatgccccaggggccagcgtaccaatttctgctgccatacccattaaaactgctggggtatgggtacaggcgttaatgacatcggcaagcgtgacgccgagtgctaaatatttcgataaaatccatggtaaggcgtaaacaggccaggcgagtttagtgatggttgagagatcgctactgatgatatccggaagaaagccattggcgatggcccggcgtgccgtgttcattgaaaaatggctgcgaccattggcggcatcaaatataacgcctcgttctcttgcatgacggacttcggctaagaccgcgccttcattagtaagaatggtgctacctttgccgtgaaacgcatgagcgataatatcgccgcggcgtagcaaggagacaagttctttcatgggaacgacgggatgagtcgagtgtattgctacggggcaccttaaatcgttggcaatacgaagggattcagtcagcggttttaagccatattcagcaatgtcctcagtctgaaccttgagttttaatccctgaagaacgttgcgatactggcgaaacagcgcgtggatcttattttcatcaatattgtcaggatcataattttcttgtgaccagatttggcccggcggcgacacggtcagaaacgctttgattcgaactttgctggcgcaaatcaccgttcggtagaaggcatcaaagtttgccgtaccggcagaacctgcatccacgacggtggtgacgccattcggcggcatgtacatatcaggcctgacgccgccttccgtcgcatcataaaaaacatgcgtgtgataatcgataagaccgggagtgacgatcatgccgtcggcatggataatccgggtctccgaagttacaggatatttatcggcatcaacgataatatcgttaatgatgcgtaacttgttaatctcattaatattacgagcgggatcgatgatatgtccaccggtaattaatatatcatttttcatcataatctcttaaaatagtaaataattatggcagcccttgaaaatatattaaaaagtgtgttttgagcggatgttatgttggattgaaaatacagttattggtagggagagcttaggataccttattaaaaaggtaatcgggcttatgcactaaataagaatttagcgcttgctaatatttagggcgtaagtccatgggagtctgggggcattcgcaaaacaattattatcttaagctttttagagaaaacgtgagcgtattcaaccctttttaataaaaaataaggtaaagtcttattcattctgtgaatgttaaactaataatgataaaaattgtgttctattcattagccaataaaaaggccctcattactatgagagcctttatcttgacgattatgtaaaagcgaacttatttcttcgctgcgcgctcgaaagaggcaacgatttccgctttagccgcttcggcgttgtcccaaccgtcaactttcacccatttgcctttttcgagatctttataatgctcgaagaaatgagtgatctgcgctttcagcagttccggcagatcgttcacatctttaatgtgatcgtactctttgctcagtttggtgtgcggtacggcaaccagtttcgcatcttcaccggattcgtcggtcattttcagtacgccaaccggacggcaacggatgacggcgcctggctgcagcgggtacggcgtcgggaccagaacgtctaccgggtcgccgtccagagacagggtatggttgatgtaaccgtagttgcacggatagaacatcgcggtggacatgaagcggtcaacgaacagcgcgccgctctctttgtcaacttcgtatttgatcggatctgcgttagccgggatctcgataacgacgtagatatcttccggcagttctttacccgccgggacgttgagtaagctcatgtctgtttcctttgaagttatgacaaacaagtggcgagtattatagccaactcacgccgaaagtcttcgcttgttttcgtttccgcctcatctggcgcgtcgttgcggagcataaacgacaaaggttaagaaccgaaaaaatcacgggcctgataaggcaacgccgccatcggacatcttattgcccaatggcggcttcatgcgttattccgcatggtggtaaagattacgcgtccgggtattcgcggataaagcgttccacatcgtcaaccatatggcggttgccgacgaagaacgagcggcgctggtgcaggctttccggaatgatatccagaatacgttctttaccatcgcttgctttgccaccggcctgttccgcgaggaacgccatcgggttgcattcatacagcagacgcagtttcccctgcggatggctggcggtgctggggtagagatagatgccgcctttcagcaggttgcggtggaaatcggccaccagagagccaatgtaacgtgaggtataagggcgacttgttgaactatcctcttcctggcagaatttgatgtacttcttcacgccattcgggaacttaatgtagttgccttcgttaatggagtaggttttacccttttccgggaaacgcatacgttcttggcacagacagaacacgcccaacgacggatcgtaggtgaaagcgtgtacgccgcagccggtggtgtaaatcagcatggtggacgagccatacacgacatatcccgcagcgacctgtttgttgccgggttgcaggaaatcttcttcggtgaccggcgtgccgacgggcgtcacgcggcgataaatcgagaaaatcgtaccgacagagacgttaacgtcgatgttagaagagccatccagagggtccatcagcaccacatatttcgcgtgttcgcagccttcaaagacgacaatttcgtcctcttcttccgatgcgatgcccgctacaatatcgcgcgcttttagtgcagctttcagtttctcgttcgcgaacagatcgagtttctgctgaacctcgccctgtacgttctcagcacagctggcacccaggatatcgaccagaccggccttgttgatatcgcggtggatgatcttggcgcccaattttattgccgacagcaaagcagtgagctcaccggtagcctgagagaactcgtgctgcttttcgacaataaattcacctaacgttttcataacactttccctgcaattgattggagtaaagcgaccgtaacaatcttaacaaacatttcagatgatgcgctcaggtgaatcgcgccagcaaagtacagatttacctgaaatgcgtttctcacttgccagacatgtgcgtaaaatggctcgcagataaaaaaaggatagtgacgtatgcgcattcatattttgggaatttgtggcactttcatgggggggctggcgatgctggctcgctcgcttggtcatgaagtaacgggttcggacgccaatgtgtatccgccgatgagtaccttacttgagaagcaaggcattgatctgatccagggttatgacgccagccagctcgatccgcagccagatctggtgattatcggcaatgcgatgacgcgcgggaatccgtgcgtggaagcggtgctggaaaaaaacattccctttatgtctggtccacagtggctgcatgactttgtgttgcgcgaccgctgggtactggcggtcgccggtacccacggtaaaaccacgaccgcaggcatggcgacctggatactggaagcgtgcgggtacaaaccgggcttcgtgatcggcggcgtaccgggcaattttgaggtttccgcacgcctgggcgagagcccattctttgttatcgaagcggatgagtacgactgcgcgttctttgataaacgttctaaatttgtgcattactgcccgcggacgctgatcctcaacaaccttgagtttgatcatgccgacatcttcgacgatctgaaagcgatccagaagcagttccaccacctggtgcgcatcgtgccggggcaggggcgcatcatctggccggaaaacgacatcaacctgaaacagaccatggcgctgggctgctggagcgagcaggagctggtgggcgagcagggacactggcaggcgaagaagctgactacggatacttccgagtgggaagtgtggctggacggcgaaaaagtcggcgatgtgaaatggggcctggtcggcgaacataacatgcacaacggtctgatggcgattgccgccgcgcgccacgtgggcgtcgcgcccgcagaagcagccagcgcgctggggtcatttattaacgctcgccgccgtctggagctacgcggtgaagcgaacggcgtgacggtgtatgacgattttgctcaccatcctacggcaattctggccacgctggcggcgctgcgcggtaaagtgggcggcaccgcgcgcattatcgcggtactggagccgcgttctaacacgatgaagatggggttatgcaaggatgacctggcgccgtcgttagggcgtgcggatgaagtgttcctgctgcagccgccgcatattccgtggcaggtttcagaagtggcggacgcctgcgtacagcctgctcactggagtggagatgtcgatacgctggcggatatggtggtgaaaaccgcacagcctggcgatcacatcctggtgatgagcaacggcggtttcggcggcatccatcagaaattgctggatgggctggcgaaaaaagcactggttgtggggtaaaaaatgcccggtggcgctgcgcttaccgggcctacaatacgtacattcccgtaggccggataaggcgttagcgccgccatccggcagacgctatcaacatgtaaaattacccttcgttttccgccagctcgcgcagatactggaagatctgacgcgctgatttcggcggtttgttgccttctttctctttcttcgcattgcggatcaatgaacgaagctgttgacgatcggcgtgcggccacagggtcagtacttcggctaccgcgtcattgccttcgacgatcagacgatcgcgcagatgctcaagcttgtgaaacagcaccacctgctgattatggcggttcttcagcttgtccagcgcctggcgaataggttcaacgtcgcgttggcgcagcatttttccgataagctgcaactggcggcggcgtccttccattttgattcgctgggccagttcaatggcgtcgcgcagatcggcgtccagcgggatcttatccagcgcgtttttccccagatccaccagttccgcgcccaggcgttttaattcctcggcatcgcgtttaatttcacttttactgacccagataatttcatcgtcttcgtcttcgatgtcatcaccgggaacgtcgtcgagccagtcttcgggctgctttgtcatgtcaggctccttaaaaaaagaggctaatgttaccagttaagatgcgcactgaaaaacggttctctgttagacttcagagaaactctctctacattatggcatttgcaatgaaagtaatctcacaagttgaagcgcagcgtaagattctggaagaagcagtttcgacagcgctggagttagcctcaggcaaatcggatggggcggaagtcgccgtcagcaagactaccggcattagcgtcagcacccgttatggtgaagtagagaatgtcgaatttaatagcgacggcgcgctgggaattacggtgtatcaccagaaccgcaaaggcagcgcctcttcgacggatttaagcccgcaggcgattgcccgtaccgtgcaggccgcgctggatatcgcgcgttacacgtcgccggacccgtgcgcaggcgtggcggacaaagaactgctggcgtttgacgcgccggatctggatttgttccacccggcagaggttacgccagacgaagccattgaactggccgcgcgtgcggaacaggcttctctaaaggcggataaacgcatcaccaataccgaaggcggtagctttaacagccattacggcattaaagtgttcggcaacagccacggtatgttgcagggatattgctccacgcgccattcgctctcaagctgcgtcatcgccgaagagaacggcgatatggagcgtgattacgcttacaccatcggccgggcaatggcggatctgcaagcgccggaatgggtcggggccgagtgcgcgcgccgtaccttatcccgcctgtcgccgcgcaagctctccaccatgaaagcgccggtcattttcgccaatgaagtggcgacagggctatttggtcatctggtcggggcgattgccggcggcgcggtataccgtaaatccacttttctgctcgactcgctgggcaaacaaattctgccggaatggttaaccatcgaagaacacccgcatctgctaaaagggctggcgtcttcaccgttcgacagcgaaggcgtgcgtacggagcgccgggacattgtgaaggatggcgtactgacgcaatggttgctgaccaactattccgcccgcaaactggggctgaaaagtaccggtcatgctggcggcattcataactggcgtatcgccgggcaggggctgaactttgagcagttactgaaagagatgggtaccggcctggtggtgacggaactgatgggccagggcgtcagcggtattaccggcgactactcccgcggcgctgcgggattctgggttgaaaatggtgaaatccagtacccggtaagtgaaattaccattgccggtaatttaaaagagatgtggcgtaatattgtcaccgtaggcgatgatattgaaacgcgcagtaatatacaatgtggttcggtattgttaccggagatgaaaatcgccggacaataatacccgtcatacttcaggctgcaggcgcgttggctgcctgcaactcgaattattcagggtattacacttatcgttaataataaaaaggaagtgagcaatgcgtaaaagcctgttagctattcttgctgtgtcatcgctggtattcggttcggctgtttttgctgccgatcttgaagataatatggatattctcaatgataacctgaaagttgttgagaaaacggatagtgcccctgagctgaaagcggcattaactaaaatgcgcgcggccgcgctggatgctcaaaaagctacgccgccaaagctggaagataaagcgccggatagcccggaaatgaaggattttcgtcacggttttgacattctggtcggccaaattgatggcgcgctgaagctggcgaacgaaggtaacgttaaagaagcgaaagcggcggcggaagcgctaaaaaccacccgcaatacgtatcataagaagtatcgttaatttttgtgggatggcggcttcgctttatccgcaggtcgccatccggcaaaatgtaatacccatcacactttctcactttatacgacaacgtcattgtttcgccatttcctctttatgccgcgatagatctcacactttcccggcgataattcatcaatgccgctttttctgtggcgcagatcacctatcccactcgcgtttccacttcgaggtggaaaataactcgctacaaacttttaacccttaccgctagttttatctcattgccattaatggggtgagacgcgtggataacggagcagtaaaacacgatgccggtgagcgaattaacgaactggctgaacaggtgttaacgcaggtggatggcctgctggggcgacatcacattgtccccaatgcggtacagacgcaaatgctgacctcgcacgttcgcgcgatggcgcaccggtcaattaccggcgagcctttaccggaagtcgatgccagcttgtttgatgaaatctcagccgaatcaatggcgctcgcccgcgaaatcgtggcggcgtttggcaaccttcctgacgaagaagcctggctattatcggtacattttgaagtcgcgaaagacaacctctaaggagcaaaaaatggaacagattaccgtcgtaattggcgatcgcctgggtaaaggccagaaagtggcggcaggcgtggaaaaagcgggcggtcgcgcggtcgtcgtaccgggcgtcgcggcagacatgaagctgggcgatgtgatgaaagcggaaaacgccaccttcggcatttcattttgcggcagcggcggcgcgggcgctatcaccgcgcaaaacaagcatggctacaaagccaaatatgggatgcggtcagtagatgaaggagtcaccgctatcaatgagggctgcaacgtgttgggtttcggctttatggataaagaagagctcggcgagcgcctggtgcaggcgtggcaaaagaaatacggcgcctgatgatgaaagagcaattcaccatcacggtgagagtaaaaggcaagggcgacgccaaagcacgcgcctttgccgatgcgctgaaccatgttcagtcggcggtgatgagagagtcgccgtatatcttactgcgtattgagccacaggatgtgcggattgttcaggcgcatgagtcggtgcgtaaagaggcctttctgtttttctttttgcgccgggaacgacgcacttacagcgtggagctggatgtggccgtcaacgtgaccgccatcaatctcgacagggtggatttcgtcgcgaaacgctgatttttattaaaaaggcatagttatgttcctgataatactaattaaatctctcattatcggcgcgctggtcggcgtaggggtgggcgctggggctgcacgtatgtttcacgcgtcaaccacgcaggggatgggcgcgttccgtacgttgggcgaactcaactcttgtgaaggcgacccggcatctcacttctcctttggactgggtttcttctttaacgcctgggcgtcgtctgtggcggccggatcgttcacccaggatgtcgatcaccgcatcatccctaactggggcgcggcggcgctaatgatcaaaaaccgtaacgtcggcgagacgctgcacgacccgaaaaaaatggcgatcgcctgcgccgtcatcggcatgatcgtcgtgacgttccttaacctgaccgcctcatccgtgccagaagcgctacaggtgacggcggttaaggtgctggtaccggcggcaaacctgctggtcaacatcgtcatgcctgtgattttctggttagcggcgatcgacgctggtaaaaaatcgggtttctgggccaccgttttcggcggcgcggcgcagctcatcatggggaacgccgtaccggggctggtgctgggtattttgatcggcaaaggcgtagaagagagcggctggaaccatgtcaccaaagtgatgatggttgccatcgttttgctgtttgtgttgagcggtttcttccgcggcttcgacatgaaaatgatcgagtctttcaacatgacggtaccgaactggcttgaactgatccacaactcgctcagcggcaaataacggagaccacaatggaagagaataaaggtttttggtatgccgactggtcgttcccgatctttgttggcctgctctcctccggcgttttcgccgggacgcatatgtactatctgtacggtatcggcgcatttaacgaagtcgcttttgtggcgatgttgaaagcggggatggataccggcgtctacggcgcggtcgccgctttcggcgccagctttttatttgcccgcattatcgaaggttcgctggtcgggattctggatatcggcggggcaattcagactggcgtgggcttaggggttccggcgttactgctgggggctggctttgtcttcccggtggcgaactttatcgcttcgctgataaccggtctggtgattggcctggcgattggctacatcattattctggcgcgtaagttcactattaatcagagcgactccacgtacggggcggacgtcatgatgggggccggtaacacttcaggccgttttctggggccgttgattatcctcagcgccatgacggcatcgattcctattggtctgggctctctggtgggcgcgctgctgttttatatctggcagaagccgattaccggcggcgcgattttaggcgcgatgatcctcggttccatcttcccggtttcgattagctaactgttgatttgtaggtcggataaggcggttgcgccgccatccggcaaaggagagaacgatgtttgatttactcctgcgccatgcgcgtctggtcgatgacacgctgactaatattgcccttcaggatggcaaaatcgcggcgttgggtgacgttgatggtccggcgctgaaaaccattgacctgcgcggcgaatgttacgttagcgcgggttggattgattctcacgttcactgctacccgaaatcgccgatttaccacgacgaaccggacagcgtgggtattgccactggcgttaccacagtggtggatgcaggcagcacaggcgctgatgatattgacgatttttacacgctgactcgtgacgcggccaccgaggtttatgcgctgctgaatgtttcacgcgttgggcttattgcccaaaacgagctggctaacatggccaatattgacgctgatgcggttcggcaggcggtaaaacgccatccggattttatcgtcggcctcaaggcgcggatgagcagcagcgtggtaggcgttaacggcatcacgccgctggaacgcgctaaagccatgcagcaagaaaacggcaacctgccgctgatggtacatattggcaataacccgccggatctggacgaaatagcggagcgtctgacggcgggcgatatcattacccactgttacaacggtaagccgaaccgtattcttcggcctgacggcgagttgcgcgcctcggtgacacgagcgctggcgcgcggcgtgcgtctggacgtcgggcatggtaccgccagcctgagctttgcggtggctaaacgcgctattagcctggggattttaccgcataccatcagttccgatatctactgccgtaaccgcatcaacggcccggtacattcgctggctaatgtgatgtcgaaattcctcgccatcggcatgtcgctgccgcaggtcattgcgtgcgtgacggccaatgccgccgatagcctgaatctgaaaaccaaaggacgtcttcagccaggtctggatgccgacctgaccctctttacgcttaaacgccagcccaccgtgttggtagacgcggaaaacgacagcttacaggctgaagaattgctgacgccgcttgccgcgatacgcgcaggcaagggctatatgaccgaacaagggagcgcggaacatgccttcgatttttgagaagtatcaattaaaacaggtgattaacgcctccggacgtatgacggcgctcggcgtctccacaccgcgcccggaagtgatagacgcggcgatggccggaatgaatcagtatttcgagatgaaagatctggtgaataaaaccggtgagtacattgcgaaattgctggaagtggaaggggcgacggtagtctcctgcgccagtgcgggccttgcccagtcggttgccgcggtactggttcaggacagcgactggctgctggaaaacctgcacgttacaccgattgaaaataacgaaatcgtcctgccaaagggccacaacgtcaactttggcgcgccggtgggaacgatggtggcgctgggcggcggcaaactggtggaagccggttacgccaacgaatgttccgccgcccagttggcggcggccattacgccgcgcacggcggctattctctatatcaaatctcaccactgcgtacagaaaagtatgctcagcgtggagcaggctgcggtggtggcgcgcacgcataatctgccgctgattgtggacacggcggcggaagaagatttgcagtgctactaccgcgtgggcgcagatctcgttatctatagcggcgcaaaagcgattgaagggccgaccagcgggctggtgattggcaaaacacagtatgttgagtgggtaaaacgtcagtcagcgggcattggccgggcgatgaaggtcggcaaagagggaattgttggcctgacctgcgccattgaattgtacctgcgggcgcaaaaagagagcggcgcggagatggtagaaaaaatggcgccctttatcgacacgttgaacacgtttaacggcgtcagcgcccgcgtggtgtgggacagcgccggacgcgatatcgcgcgcacggaaattaagtttgatgaagccgttaccggcatcgccacaggcgacctggtcgacgcgctgaagcaaggggaatacgcgatttactttcgcggatacaaagccaacgaagggattattgaagcggatgtccgcagcgtcgatcgcgcgcagttagcgattgtggcgcgtcgtattggcgaggtgattaatcaggagaaacaagcatgaaactgacccctaacttttaccgcgatcgcgtttgcctgaacgtactggccggttcgaaagataacgcccgggaaatctacgcggcggcggaaggtcatgtgctggttggcgtgctctccaaaaactatccggatgtggcaagcgcagtcgcggatatgcgtgaatatgcggcgcttatcgacaatgcgctctccgtcggattgggggcaggcgatcctaaccagtcggcgatggtgagcgaaatctcgcgtcaggtacagccgcagcatgtcaaccaggtgtttaccggcgtagggggcagccgggcgctgctggggcaaaacgagacggtggtgaacggtcttgtctcgccgaccggcacgccggggctggtgaaaatttccaccggcccgctaagcagccgcgcgccggacggcatcgtacccatagaaacggcgattgcgctactcaaagacatgggcggcagctctgttaaatactttccgatgggaggactcacctgtcgcgacgagtataaagcggtggctgacgcctgcgcccgccatgatttctggctggaaccgacgggcggtatcgatctggaaaacttcgccgagattctgcacatcgcccttgatgcaggtgtaagcaaaatcattcctcacatttatagttcgattattgataaggtgagcggcaacacccgtgcggacgatgtgcgtcagttactcgctatcgtccggtcgcgtgtcggctaatcatgaggagagagacgtgcgattccccaaccaacgtttagcgcagctatttgcgatgctgcaaaacgagacgctgccgcaggacgagctggcgcagcggttgtcggtctccacgcgtaccgttcgggcggatatcgccgcgctgaacatgttgctgacgccgcatggcgcgcaatttactctcagtcgcggcaacgggtatcaactcaaaattgatgatccggcacgttatcaatccctgcaaacgcagcaatctcccacgctggcgcgcggtccgcgcaccagccaggagcggatccactatttgctggcgcgttttttaacctccgccttctcgctgaagctggaggatttagcagatgaatggtttgtcagccgtgcgacgttgcagaacgatatggcggacgtgcgcgagcatttgctgcgttatcatctgacgctggaaacgcgtccgcgtcatggcatgaaattgtttggcggagagatggcgattcgcgcctgtctgaccgaccttttatggacgctggtgcagcaggagccctcccatccgttaattgttagtaccacgctgaacaccgaggtgtctcaacggctgcagtctcttttgccggatattttctctcattgtcaaatccgcctgaccgatgagggcgagctgtttctgcgtttatactgcgcggtggcggtacggcgtattcgcgaggggtatccgttatcggaatgcgtggcagaggaggtcgatgaaaaggtgcgccatgcggcgcatgagattgcggagctactacaacagctggctgacaagccgctgtcggagccggaagtaagctggctgaaggtgcatattgccgcccgccaggtacaggagattgcccccagcgccattaatgccgatgatgaagaggcgctggtgcactatatcctcaattttattaatactcagtacaactataatctgttgaatgataaacagcttcacgcggacttgctgacccacatcaaaacgatgatcacccgcgtgcgctaccagatcatgatccccaacccactactggaaaatattaagcagcactatccgatggcgtgggatatgacgttggcggcgatatcgagttggggaaaatacacgccgtataccattagcgaaaacgaaatcggttttctggtgctgcatattggcgttgggctggaacgtagttacaacattggctaccagcggcagccgcaggtactgctggtgtgcgatgctggtaatgcgatggtgcggatgattgaagcggtactggcgcggaaatacccgcagattgagattgcccgcactctgacgctacgcgactatgaggcgcgggacagtatggtggaggattttgtgatttccacagcgcggatcggcgaaaaagataagccggtcatcatgatcgcgccctttcctaccgactatcaattggagcagatcggtaagctggtgctggtggacagaacccgtccgtggatgctggataaatatttcgatgcctcgcattttcgcatcgtggagggggaaataaatcaacagacgctgtttaaaacgctgtgcgatcagttgcacgaggaaggctttgttgatgcggcgtttctcgattcggttattgaacgtgaagctatcgtcagtacgttattaggcgacgggattgccttgccacacgcgctggggctgctggcgaagaaaacggtggtttatacggtgctcgcgccgcaggggattgcctggggtgacgaaacggcgcacgttatttttttactcgccatcagcaaaagtgaatatgaagaggcgatggccatctacgatattttcgtcactttcctgcgcgaacgcgccatgacgcgcctctgcgcatgtcagaattttacgcaatttaaaacggtcgcaatggagtgtgtgagtcgcttttgagaggcgttatccagaattcgatgtaatgcgaatgtaatgctaaactgcattacacattcgattctcctggaggcataatggccacgctgaacgtccgtctggatgacaaactcaaaaatgaggcttatgccgtgctggaaaaactgaacattactccaacggaagccgtgcgattactgttccagtacgtcgcggaaacggggcgcatgccagtgaaaaccgtcactcttagcgacagtgaagatgcactgattcagacagttcgggagaggctgtctagtccgcaaaagggaatcaaggttagtctggatgacttatgaactggaattcgacccgagggccttaaaagagtggcataagctgggcgatacggtgaaggctcagcttaagaaaaagttggctgatgtgctattgaaccccagaatcgactctgcccgtttaaacggtcttcctgactgctataaaattaagcttaaatcgtccggttatcgtctggtgtaccaggttcgggatgacgttgtgattgtgtttgttgttgcggtcggcaagcgagaacattcagccgtctatcacgatgcaaacaaacggctttagcgatcaacgcaaatgatgcactacttggttgctgctaccgcgccagataagcgccgggtctttcagatcctgcacaaatttgccatcgaccagcacgttgatgagattgaccacctgcatctgtgcggcgttgagttcatcgagcctgtagccggtccacacccagatatctttccccgggcactccgcgtggatgcgttgtaccagtgccaggatatccggtacgttttgcggatgcagcggatcgccgcccgacagcgagatcccctgacggtgaatgcgcgtgtcgttcagatcggcaatgatcttatcttccatctctttggtaaacggctggccggaattgagccgccaggtgcttttgttatagcagccagggcattcatgcacgcaccctgacacaaacagggtgcagcgggtaccggggccgttaacgatgtcgacgggatagtattgatggtagcgcatagcgggtgtccagaaagcatgtaggccggataaggtgcttgcaccgcatccggcaacattgtgatgcctgatgacgacgcgattgcgtcttatcaggcctacggtctttgcaaacggaaattaacctatctgcccgttgcctaaatgcttcacgcggcgcttcacttcttcctgcttaccggcgttaaacggacgcgcgtccgggctgcctaaataaccgcacacgcgacgggtaaccgagacgcgcgcggcgtcgtggttgccgcatttcgggcaggtgaaacctttactggtacattcgaactcgccggtaaagccgcactcgtagcattcatcgatcggcgtgttggtgccgtaatacggtacatgctgatagctgtaatcccagacatcttccagcgctttcaggttgtgctgaatgttcgggtattcgccgtagcaaatgaaacccccgttcgccagcggcggatacggcgcttcgaaactgattttgtcgtacgggttgaccttcttctccacgtcgaggtggaagctgttggtgtagtaacctttatcggttacgcccggcaccacgccgaactcggcggtatccagacggcagaagcggtcacagaggttttcacttggcgtgctgtacagactaaagccgtagccggtctcgtctttccactgatccacggcctggcgcagacgctccacaatcgcgatgcctttagcgcgaagttgctcgctgtcgtacaggtgttcgccgccgaacagcgcgttaatggtttcatggataccaatgtagcccagagagatggacgcacgaccatttttaaagatttcagacacgtcgtcgtccgctttcagccgcacgccgcaggcgccttccatatacaggataggcgcgacacgggctttcacgccttcaaggcgggcgatacgggtcatcagcgccttccgcgccagcgccagacgttcatccagcagtttccagaatgcggtttcgtcgccttttgcttccagcgcgatgcgcggcaggttaaggctaatcacgcccaagttgttacgcccgtcgtggatctgctcgccgttttcgttctcccacacgccgaggaaactgcggcagcccattggcgttttgaacgaaccggtgactttgaccacctgatcgtagttgagaatgtccggatacatgcgcttgctcgcgcactccagcgccagttgtttaatgtcgtagttcggatcgccaaacttgtggttcaaaccatcgcggatagcgaagaccagttttgggaacacggcggttttgcgatttttacccagaccggcgatacggttacgcaaaatagacgcctggatcagacgcgactcccaactggtgccgaggccaaaaccaaaggtcacgaaaggcgtctggccgttagcggtgtgcagcgtgttaacttcgtattccagcgactggaaggcgtcgtagcactctttttcggtgcgagaacgcgcatacccttcggcatccgggatctgccactcatcggcggttttgcggtgcttgttatagctttcggtgacaaacggcgccagcacttcgtcgatacggttaatggtggtgccgccataaatatggctggcgacctgcgcgataatctgcgcggtaacggcagtggcggtagagatagattttggcggttcgatctcggcgttacccatcttaaagccctgggtcaacatgcctttcaggtcgatcaacatacagttgaacatcgggaagaacggcgaatagtcgagatcgtgatagtggatatcgccgcgctcatgcgcttgtactacgtcacgcggcaacaggtgctggcgggcatagtgtttggcgacaatcccggccagcaaatcgcgctgggtgggaatgactttactgtctttgttggcgttttcattgagcaacgcggagttagtttgctctaccaggccgcgaatttcctggttcagacgaccacgcttttcacgctgaatgtcacgatcgtgacggtattcgatgtaggcgcgggcaagctgtttgtacgggccggacatcagttggttttcaaccgcagtttggatctcgttaatatccacctgactgcgtgcgttcatttggctgctaacgacttctgcgacggtggcacagtaatctgcgtcatcgactcccgctgctttagctgcacgtagaatggcttccttaatgcgctctgatttgaatggcactttacagccatctcgtttcatcacatgcggtgtcatgatcactccatatttgtaagaacaggttatccacagaggccggggaagccataacaggtttattcatctcttttccaatgacttcccgcaatcctgacccaggttatccacaattcaccttgtgtcgagtgaacaggtgttgtagcaattgtagtcaattaatacaacatattgggtcggcgtgcattttaaagtctatatgtagtgatttgcatcaaggatgtttgcaattttattgatgtagaacaaggtaaaaatcagagcgtacagatggcgggcgctgtagcgtttgtaaaagatagcaagaaaaatctgattaattattcaacaaaaacagacagtaacctggagcaacgccacagcccgtgtcaataggtttgtggcgtttatccgtataaggacgtcgcgttagcgttgtaaccaccagatggcttcaaatgggcggagcgtcatcgcggctggctggctggcgacctcgccataattatgcagtagcgcctgccactgtcctttgatatgcggtggatgccactcctgacactggtcgctcagattggcgacaaccagcagggtttgcccctgccactggcgacgataacaccatactgatgggctacccgggaggagatcctgataatcgccccagatcattacaggctgggttttacgtagcgcaatcagcttttgataggtgtaaaacaccgagttttcatcgcgtaatgccgccgcgacattaacctccgtatagttatcgcacaggcttatccacggctcgccctgggtgaaaccggcgtttttaccgttgtcccactgcatcggcgtgcggctgttgtcgcgggatttactggccaggatagccagtagttcgtcggggtcgcgtccggcggcgcgtagcgcggcaaacatgttatggctttccacgtcgcgataatcggtgatgcgggtaaagtgtgggttggtcatgccgatttcttcgccctgatagatataaggcgtcccttgcataccgtgcagcgccatcgccagcattttcgcggctggaacccggtattcaccctcgtcgccaaagcgggaaacgatgcgcggctgatcgtgattacaccagaataacgcgttccaggcgacgttatgcatcccctgttgccattggcggaacaacgctttcagcgccacataatcaggttttgccagcgtccacttttcgccattggggtaatccaccttcagatgatgaaaattgaaggtcatcgagagttcgtcgccgctaagcgcggcatattgctggcagttttccagcgtggtagaggacatttcgcctaccgtcatcagattacgcggcgtaaaaacgtcacggttcatttcgcgtaaaaacgtatgcgtgcgcggtccgtcggtataaaagcggcgtccgtcgcccgtcggatcgtcaggaaaatcctgatctttggcgatcaggttcaccacgtccagacgcaggccatccacgtcgcgatcggcccagaattcgcagacctttttcagctcggcgcgcacggcggggttttcccagttcaggtcggcctgttcaggcgcgaaaaggtgtaaataatattgttcgctctggctatgccagcgccaggcgctgccgccaaatttggattgccagttattcgggcagacatccggcgtgccgtcgcgccagatgtaaaactgacggtatgggctctctttgttcagcgcttcgcgaaaccaggcgtgctgggtagaagtatggttaaacaccatatccaggatgatgcgaatgccgcgtgctttcgcctgcgcgaccagctcgtcaaaatcatccagcgtgccgtaggtcgggtcgatagccgtataatttgcgacgtcataaccgttatccacctgtggcgagatataaaacggcgtgagccagatggcgtccacgccgagtcgctgtagatagtcaaggcgctgcgtgacgccgcgtaaatcgccggtgccgctgccggtcgtgtcctgaaaacttttcgggtagatctgataaataacgccgttttgccaccagaggggaatagtcattgtagtttcctgcaagtacgttgggacgcaactgcgccccgaagaagaattagacaatttgtaatgtgccctgacgatgcttacgctgatagataaaggtggtcagaatcaccgggataacgatcgcgataaccatcgccatcgcaaacacctgccagtaagtcggctggatagagagaatgcccggcaggccgccaacgccgatgccgtttgccattacgccattcagaccacagagcagaccggcaaggccagagccgatcatcgcgcacagcatcgggaagcgatatttgatgttgatgctgtacattgccggttcggtcacccccagataggcggagatcgccgccggaacggaaatttcacgttcattgtgtttacggctggagatgataatgcccaccacggcggaggcttgcgcgatattcgacagcgcaatcagcggccagactggcgtaccgcccatgctctgaaccatctgcatatcgatagcgagcgtggtctggtggacgccggtaatgaccaacggggcatacaggaagccgaacagcgccgcgcctatcggggcgaaactgccggtcatcagataacgtaccgcaaaggccacgccgtcgccgatcatgcgaccaaaggggccgataaaggcgtgggcgagaaagacggccagtattaacgaacacaccgggacgacgaccaggtagagataatccggcacgatgcgtttcaaccgcgtttcaataaatccaagcgccagtcctgccagtagcgccgggataacctgcgcctggtagcctattttctcaatactaaatacgccgaagttccagacgtccggcgtttgctggcccagcagatacgcattcatcaactgcggcgacaccagcgtcacgccgagcacgataccaagaatcggcgtgccgcccatttttttcatcgccgaccagcagatccccaccggcagatagaaaaagatcgcttcgccgatcaaccataaaaaatcataaagcgtttttagcgccggatgcatctgcgccagtgtttgaccgtggctcatcggcacatcgccgatcacgttacgaaagcctaagatcaaaccgccgctgatcaatgccggtagtagcggaaagaagatctccgcgaagtgggaaattaactgctcatgccacttcatgttctggcgagcggctttttttgcctgctctttatcagcatacgctttgccggtggtctccagcagcgcgttatagtaatcgccgacttcggtgccgatcaccacctgaaactgcccggcgttggtgaaacagcctttaaccatcggcaattgttcgatctcttttggtcgggcgttcgcgggctggtggagcacaaagcgcaggcgagtaatgcagtggctcaccgtggcgatgttgtcgcgcccgccaaccaggtcaatcagccggtcgatatcggcttgttttactttgctcatcgtaaagcctcatggcagaggaggtaagttatgggttggcgcaagagtagctcttcaacgttggtttaaaaatgggaacgttcccgaaacgcggcgacgatcacaaattacgcatggtattccgtttaatcagccactcaggcgagggtagaaggaatgacgatccggcgcggatcgcagcggccattgatctgttcgatcagctgcaaagccgcctgccgtccggcttcagcatagccaggatcgacagtgacgatctccggatgcaggaattttatcagcggcgtattcccgatgcttgccagttgcagcgtctcaatacgttgctcctgtaaatacttactggcgcccaacgccagcgtatcggtggcgcagactaacgcggtggtatccggcatgatgacacttgccgtatgctcatagccctgcttcatggcaagaccgggaagggcggcgacgggatgaagtttatgttttttgcaaaacgccaggtatgcgtcatgccgacgtttgccggtggtaatatcgctatgaggaacgcccagaaagctaatgttgcggtgtccctgctcatacagccgctgcataaggatatgaatcgcgccctcgtcgtcgtaacagacggaggcaaaaccttgcgcatctcttgccagcagcaccagcgaggctttccagggggcgatcaactcttctgtgatgccggtaaagccaaacagcaccacgccatcaatgttacgtcgcctgagcatgcccagatgttccattaccagcatcggcgagaactgactttccatcataatagggtcgtagccctgttcataaaacgcaggcagcatggtctgaaccgcgaggttttcagacaacgaatcaaggcgagtgacgataatagcgaccactttatcgctttgtccccgcatcgcacgggcggagcgggacggagagaaaccgtgttgattcatcaccgcttcgacacgctcgcgggtacgtttgcttacgccgctttcattgttaagcacgcgggaaacggttgatttccctacgccgctcaggcgggcaatgtctttgatagtgagccggttttgcatcctgttttcccgtggcgtgacgctgatggtgataaaaagagtaactttactcaagcgaagggcaatgggcaaagtctggtttatcgttggtttaattacgtaacggtatgataccgccataattgccacaaaacttatggatttatgcgtataatccgcggcgcaaattatttacttaccggaggcgacatggaccctgaacccacccctctcccgcgatggagaattttccttttccggtaagcctgcctctgctgtcttaccggtgtgtaagacagtgacacaataacgtccctgtttttatttaaacattgctcatcgggcaaggctttgccgcgcctgaagaattttctgcgcctgacttcggcgcggagggattacctatgctaaaaaccattacccgccagctttttgcccggcttaatcgtcatttgccttatcgtctggttcaccgcgatccgctgcccggcgcgcagaccgcggtaaacgcgactatcccgccttcgctgagcgagcgctgtctgaaaatcgcggcaatggagcaggagacgctctggcgcgtttttgatacgcacccggagggattaaacgccgccgaggtgacgcgtgcgcgtgaaaagcatggcgaaaaccgccttccggcacagaaaccctcgccgtggtgggtgcatctgtgggtatgttatcgcaatcctttcaacattttactcacgattcttggcggcatttcttatgccacggaggatctgtttgccgcaggcgttatcgccctgatggtcggtatctcaacgctgctgaattttgtgcaggaagcgcgctcgacgaaagcggcggacgcgctaaaagcgatggtgagcaataccgctaccgtactgcgggttattaatgaaaatggcgaaaacgcctggctggaattacccatcgatcaactggtgcccggcgatattattaagctggcggcgggggatatgatcccggcggatttacggattatccaggcgcgcgatctgtttgtcgcccaggcgtcgctgaccggcgaatctctgccggtcgagaaagtcgccacgacgcgtgagccccggcaaaataacccgcttgagtgcgacacgctgtgctttatggggacgaacgtcgtgagcggaacggcgcaggccgtggtgatggcgaccggcgccgacacctggtttggtcaattggcggggcgcgtgtcggaacaagataacgagcagaacgctttccagaaaggaattagccgcgtcagtatgttgctgatccgctttatgctggtcatggcgccggtagtactgattattaatggttacacgaaaggtgactggtgggaagcggcgctatttgcgctctcggtcgcggtaggactcaccccggaaatgttgccgatgatcgtcacctctaccctcgcgcgcggggcggtgaagctctcgaaacagaaagttatcgtgaagcaccttgatgcgattcagaacttcggcgcgatggatattctgtgcaccgataaaaccggcacattgacgcaggacaaaattatgctggaaaatcatacagatatttccggtaagcccagcgagcatgtactgcattgcgcctggctgaacagccattatcagaccggtctaaaaaatttactggatacggcggtcctggagggagtagacgaaaccgccgcgcgtcagctctccggacgctggcagaaaatcgatgagattccgtttgattttgagcgtcgccggatgtcggtggtggtcgccgaagattcgaatgtgcatcaactggtctgcaaaggcgcgctacaggagatcctgaacgtgtgtactcaggtgcgccacaacggcgatattgtgccgctggacgacaatatgctgcgccgggtgaaacgcgttaccgacacgctgaaccgtcaggggctacgcgtggtcgccgtcgcgaccaaatacctgcctgcgcgtgagggcgattaccaacgtatcgatgagtctgacctcattctggaagggtatatcgcttttctcgatccgccgaaagagaccaccgcgccggcgttgaaagcgctgaaggcgagcggaattacggtgaaaattctcaccggcgacagcgagctggtagcggcgaaagtttgccatgaggttgggctggatgcgggcgatgtcgttattggcagtgatattgaaggattaagcgacgacgcgctggcggcgctggccgcccgtacgacgttgtttgcgcgtctgacgccgatgcataaagagcgcatcgtcactttgctcaaacgcgaggggcatgtggtcggttttatgggcgacgggattaacgatgccccggcgttgcgggcagcggatattggtatctcggtagatggcgcggtggacatcgcccgtgaggcggccgatattatcctgctggaaaagagcctgatggtgctggaagaaggcgtcattgaaggtcgtcgtactttttctaatatgttgaaatatatcaagatgacggccagctcaaatttcggtaacgtgtttagcgtgctggtagcgagcgcttttttgccgttcctgccaatgctgccgctgcacttgctgattcaaaacctgctgtacgatgtatcccaggtggcgattccgtttgataatgtcgatgaagaacaaattcaaaagccgcagcgctggaatccggcggatttggggcgctttatggtctttttcggtccgatcagctcgattttcgacattttgaccttttgtctgatgtggtgggtatttcatgcgaatacgccagaaacgcaaaccttgttccagtccggctggtttgtggtgggattactatcgcaaacgctgattgtgcatatgatccgtacccgtcgtctgccgtttattcaaagtcgcgccgcctggccgctgatggcgatgacgttgttggtgatggtcgtgggagtttcgttgccgttttcgccgctggcgtcttacctgcagttgcaggcgctgccgttaagctatttcccgtggctgattgctattctggcgggctatatgacgttaacccagttagtgaaagggttttacagccgacgttatggctggcagtaaacactttcgtcggggattcgccagcgtgcttaatccccgatatcgctaaccaaaccagatgcccgtaaagctcgacaagtttaacgcgatcggctttatctttaaatttcagggcttattcaagcaactgtagaatgctatatgcaggcataaaaaagaggaatgtccagctaagtttgtaaaatacattctctgcccccgagccagaacgagaggaggagatgtcccaccgctggatatgttttgcggatatgcgacgaaagcggcgaatatagctaatgcaataaactaagtaaggaggaatcgctaaggcggcagtgggtttaggaaacataagggtaagcaatatggctgcgataatgaagcataaaaagacgatcttcgcagtagattctatctgttttaattcctggcgtatgctttcagcatgtttctcctgccagcgacggagcgtgctgttgctaaatccatattcttcgcataacgccttattcggcacgccgtttttagactgttgcagaaaatcggcgatttgctcctcggtaaaacgcgctcttaccattgccgcctctccatggctgttggtgccccgaaccgggcaaacttgcgccgcccggcggggatgacgtccggcgcttagcgacgaacagcgatcgcttcaatctcaattttcacgtctttcggcagacgggcaacttccacgcaggaacgcgccgggaaggtcgcgttgtgctcggtgaagaacgcttcgtaggtggcgttgacggtcgcgaaatcgttcaggtctttcacgaagacggtcgttttcacaatgtcgcctactttcaggccagcggcttccacgatagctttaacgttttccagcgactgacgtgcctgagcggatgcgtcttccgctacggcgccggttttcggatcgaccggaatctgaccggaagtgattaccatgctacccaggtctacgccctgtacgtaagggccgattgctgctggtgcattttccgtcgcaatagttttgctcatgatttctcctgaattacagcggtaatagaatgtccccgctcattatagggagccgggatctcataaccaacccccattagttggccagcaccacattatgcgaaaactctttttcacagtatttgcatttgagggcgatatcattggcgcgttttttcactgcaaagctggaggataccggttccgcgtggctgatgcagttgctgttcgggcaaaccagcacattattaatacgctctggcaggctggggcgcgatttcccgaccacgtcgtagttgtcgatgcggttaacggtggcctgcggcgcgtacagagcaagttggttaacctgctcatcggtgaggaaggtgttttctattttgattaagtctttacgccccatctcgccagacgggagattcagaccgatagtgattcgctgatcggtctcggtcaatttaaacagactcagcagtttaaagcctacctgcgcagggatatggtcaatcacggtgccgcatttaatggcttcaacctgcagtttgttatcgtgtgtcatcgcttttctcccttacagactcagttcgctattcagtaccaacgccagtaacgcctggcgagcgaaaataccgttgcccgcctgttggaagtaccaggcgtgtggcgttttatccacatccgtggtgatttcatcaatcctcggcagcgggtgcagcactttcatattttcacgcgcgccgttcaggtcgctggcgcgcagaacaaactgcgccttcacattggcgtactccgacgggtcgagacgctctttctgtacgcgagtcatatagaggatgtcgacgtcggccatgacctcttcaatagaaccatgcaggctccaggccatccctttttcatccagcatatccagaatgtactgcggcatcgccagcgcgtccggcgcgataaaataaaaacggttgccgctaaatttcgccagcgcctgggttagcgaatgcacggtgcggccatatttcagatcgccgaccatcgcgatatgcaggttatccagacggccctgcgtttcctggatggtgaacagatccaacagagtttgcgtcggatgctgattcgaaccgtcgcccgcattgagcaccggcacctgaccggaaaactccgtcgccagacgtgccgcgccttcttgcggatggcgcatcacaatcgcgtccacgtaagtgctaatcactgagatcgtgtcggctaacgtttctccttttttccccagcgacgtgttggcgctgtcggagaagcccactacgctggcgcccaggcgatgcattgaggtttcaaacgacaggcgggtacgcgtggaggcttcgaaaaagcagctggcgatcactttatgtttcaaaagctccggctgcgggttggcttttaatttcgccgccgtcgccagtaccagattaagatcgtcgcggctgaggtcgtttatggaaatgatatgtttttgatatagcgggttagccatgtttatctcctgacgcctgggcaaaaaaaagcccctcaattgaggggcttggtattggttttcaacggaaagaaaaacggcaggcctgcgtcttttttcagacgcggtaagacagaatgtcgtacacactgaaccatgcttcctcccggcaaattgtccgcgattatactcagctctgttttgggatcaagcgaattaatgcatgatttacttgtcgcaaacggttcttatgaatttaaattcattttaagcaaataattaatttgtttgtgtaccagcgccgtgcgctgaacgatctgtggtgcgacccagacaatactgctaccggcaacgacgccgagaatttccggcaatgcgtggtaatccagaattctcgcgacggcgcgaccataacctgccgccgtatggataaggataaattcgctattatgttcaacgctgacgaccatttcggctattgaacgtccggcatccggcgaaggacgctgctggggatttacggaataaatcttttgtcctttcgcatttctgatttttattgcgcccagcagcttgagcaggcgcgaaaccgtagactgactgataccttcaaatccctcattttgtaaatcgcggcgaatctcctcctgggacaggtaacttttttcactaatcaggcgctgacaaaccgccagttgctgttgttctttggcggagtaatcatcgtatttcttcataaatgcaccttatctttattattgatatcaacggactggcgaaattcatcacatttgtcacattgattgcggatcaatcgggcggttttgcaggaaaatgagaagctgatcaaaaaaggtgacggcgtgcctgatggcgctgtgcttatcagtcctgtcggataagacgcgtcgccatctggctcgttacatcatcgctccgatgctcagtaccgccatattcagcaatgtcaggatcagcaacagcggcgcgacccatttcagatagcgaacatagggaacccgcgcgatcgccagaccgcccatgaccacggcggaggtgggcgtaaccaggttcacaatcccggaggccgactggtaggcggttacgaccaaatcccgctgtacgtgggcaaaatccgctaacggcgccataatgggcatcgtcaatacggcaagaccggaagaggagggcaccaggaaggagagcaatacttccagccagtaggttacgtttatgaaaatggtggtagagaggccggaaaccagactttccgcgctgtgcaaaatggtgtgggtaatcataccgttatccatgaccaccacaatgccgcgcgcgataccaataattagcgccacgccgagcaaatcccgcgcgccgtcgataaaggtactggtgaacgcttcctcgcccatccgcgttatcacgccaacgataatcgccgccgccagaaagacgccggagatttccgccatccaccagccgagaaccgccacgccgtaaatcatcaccgcgaaagaggcggcgaagatcagcagcacccatttccgggtagccgtaaactccagcagtgtattggcgcgattgccgaggaaatgggcgcggttttccgccattttatccgccacgatagaaagctcaggatgggcgcggactttgcgtgcatagcgcattacccaaaacacgcacagtacgtagccgacaattaacagcagtacacgcatcagcatgccctgcgtaaaagggatgccggcggcgttggcggcaatgaccgtggcgaaaggattaatggtcgaaccgagcgtgcctatccccgcgccgagcagtacggttgccgtcgccactaacggatcgaagcgggccgccatcatgaccggcaccagcagcgtgtagaagggcaacgactcctccgccatgccatagatagtgccgcctgcggcgaacagcgccatcagaatggggatcatccactcatctttgccgttgagtttgatagttacccgttcaataccggcatcaatcgcccccgttttattcaccacccccagaaagccgccgataatcaagacaaacagcgcgacgtcaatggcgccggcggtgtaggtttcgtggttatagaggccgtcaatcggcgccagtaaaacagcggtaatcccttgcggatgcgcgtccacgggggcatacgttcccgccaccggcacctcttttcccagcgtggcgttcatcgccatttggtattttcccgccggcacaatccaggtcatcaccgcgaccagggcaataagaataaacaggatggtataagcggtgggaaatttaaatttacccatgatgttctctcctgatatcacggatatgcgccgcgagggcgcatatcctgtgggattagtcgccgagcgtcgccaccatgaccgctttgatggtgtgcatccggttttccgcttcatcgaagaccatcgagcctgcggactcgaacacctcttccgtgacctccagtcctttcaggccgtaagccatttcgatttcgcgtcccactttggtgtgctcgttatggaaggcgggcaggcagtgcataaacttcacatcaggattaccggtagcgtttaccacctgctggttgacctgatatggcgtcatcagactgacgcgctccgcccaggcttctttgggttctcccatcgagacccagacgtcggtatagaggaaatccacaccgtgaacgccatcttcaacgctctccgttaaggtgatacgagcgccggtaacgctggcgatttcccggcactgcgcgaccagcgcggcatcaggccagaaggactttggcgctatcagacggatatccatgcccatcttcgccgcgcccaccatcagcgaattgcccatgttgttgcgcgcgtcgcccaggtaggcgaagctcagttccggcagcgttttgcccggcgcatgttccagcatggtcatcagatcggccaggatctgtgtggggtgaaattcatcggtcaggccgttccagacgggaacgcccgcgtattcccccagctcttccacaatgtgttgaccaaatccgcgatattcgatgccgtcatacatccgccccaggacgcgagcagtatctttcatggactctttatggccgatctgcgagccgcttgggccgagataagtcacctgcgcgccctggtcgaacgcggcgacttcaaacgcgcatcgggtgcgagtagaggttttttcaaaaatcagcgcgatgtttttgccgatcagtgtttgcttttcgcatccggctttttttgcggctttcagctcaatagccagatcgatgaggtgttggatttccgccggggtgtagtcaagcagcttcaaaaagttacgatttttcagtgaaataaccattacaatatccttgttaaaatgaattgcctgatggcgctgcgcttatccggcccacggttatgcgcgctctgtaggccggataaggcgcaagccgccatccggtaaaaagccttatgcgtcaacgtcggcggtttcacaccgaatcaaagtacctttctcgcccgcgagaatggcttgcccatccgccagcgagccgattccggcaatgccgcagcaatggctgacaaactcagcgcaggcggtcactttcgggcccatcgaaccggcgtcgaactgcatttcacgaagcagctccggcgtaacctgcgccagcgggcgttgggtgggtttgccccagtcgagatacaccgcgtcgacatcggtcagaatgagcagcgcgtcggcgtgaatttggctggcaagcagggcggcggacagatctttgtcgatcaccgcctcgataccgtggtagccatcggctttttccacgaccggcacaccgccgccgccgttacagataaccaggtgatcgcggctaatcagcgcgcggatggcatcgttttccacaatgcgtttcggctgcgaggagggcacaacgcggcggaaggcgttaccgtcggctttgaatacccagcccttttctgcctgtaacgcacgggcctgcgcttcgtcgtaaatggggccgatatatttggttggattgaggaatgccgggtcgttggcatcgacttcgacctgggtgagcaggacgctgatttcacgctccggcagatgattcttcagcgcctgttgcagcatgtagccaatcatgccctggctttccgcaccgagaatatcgagcgggtagggcgtaacgttagcgtaggcgctattttgtagcgccagcagccctatctgtgggccgttgccatgcactaacactacgcgccattgccgggtaagctgggcgatggttctggccgccagttcgatatttttacgctgaatatcagcctccagcggttcgccgcgtttgagcagcgcattgccgcccagcgcgacgaccagtgtgcgtttgttttccataacgtctcctttaaataccatcgcgttccagtggacagctcatgcagcgtgcgcctccgcgcccgcgacccagttcatcgccgggaatgggaaggacggtaatgccggctttgtcgtatttttcgttggtccagatgttgcgctcatagcccaccaccacgccgggacgcagggtgagcacgttattggcgtcattccactgttcgcgctcagcttcaaatgcgtcgccgccagtggtgattaagcgcacctgatcgatgccaagcgctgtttcaagagcatgaaccagcgtgctctcctgggttcgtttcagaccgccgcgtccgtctggcgtcagcgtccagcactgaacgtccgggcgaacgacttccggatagacagagaaggtgtcgatatcaatgtgggtcatgacggtgtcaaggtgcatgcaggagcgatgttttggcagttcaacggcaatgacgcgttccgcctgacgatgtttaaacaatgcctgcgccaggaactcgacaccctgcggcgtagtacgttcagacataccgatcaacaccgcgccgcggccaatcaccagcacatcgccgccctctaaagtggcgtggtcgtaattaatgttctcgtcgccgaaatatttaatgaaatcaccgtctgcgaattgtggatgccagcgataaatagcacgtaaattattcgtttcacgttggcgtgcaggtttcgccatggggttaattgagacgccgttatatatccagcaggacgtgtcacgggtaaataggtgattcggtaatggcttcataataaagtcattaatatcgtgagtatcgaccaccatattttttatggaggcggggatttcgccgtaagttaaaccgccgcttaaatggcgagccagttcacggtgcggcatatccgccagccaggcgcgaatatctgcggcaaaggtgggcccaaggcgataatcggaaatttgcgtatccagtagccaggctttagcgtcagccacatccagtgtttgggtgagcaggtcggttaacagcaacacttctatcccttgctggcgcagcgtgttggcaaaaatgtcatgctcttcgccagcgcgctctacggataatacatcgtcaaaaagtaattcctgacaatttgaaggggtaagtctttttaggctgagattgggacgatgcaacattacgctgcgtaattgaccgatttcagaaccgacaaaatgcttttccatcattataccttttacataatttcaagaataaagaaggagtggctgcaaatatttagcgtgcttgcagtcgcggcgtttcagttaaattcgggagcaatgattgaattttatttgggttgttaatgtgatgagattcacattaattaaggagtgctatttttcttacttaatatatgagccgggtcagagaaattcaaaaaacaataaggcattaaatgaattactacgcagctatatggtttgttattttttattgttaattatttgtttgttgtattgaatgatatttaaatcttaaccacttgaaaataaagtgattatttttaagggttgcataactatgcgtgagggggattttattatcggggatatttaaataatttaaaaataactatggatatagaagtcatttatgcagggagagcgaattgtgatcgctaaaacgtttttatgttaacgcctttaatatcaaagcgttgttagtgatggcaatttggctccgctgaggttaatgcataggtactgcataaagttgggcgaactattaacaatatataaacaccgctggcgataaacatgcgctggcgcaaaatcgatgagagtaagggtagtatggcagccatttttctcgtataaagagaaaaataaaacgctgttttaactaaggagatgcgatgattgttggcaatattgaacatctggaggcctggctgccgacggcgttacggcaggcgattgagcacgtcaacgcgcatgtcacggcaacgaccgcgccaggtaagtatgacattgacggcgacaggctgttttatatgatttctgaaaatatgacggagccgggcgaatcgcgcagcgcagagtatcacgcccgttatcttgatattcagattgtgctacaaggtcaggaagggatggcattcagtacccggcctgcgggaacgccgcacacggactggttggcggataaagacattgcatttttaccgacgagcgtcgacgagaaaaccgtcgtcctgaacgaaggtgactttgtggtgttttatcccggcgaagtgcataagcccctgtgcgcggtgggagaaccggcgcgggtacgtaaagcggttgtgaaaatgctgatggcgtaatattttgtgccggatggcggcgcctgcacgttgcgatcttgtaggccaaccgccatccggcatcataacgacattatttagacagcgtcgctaccattaccgctttgatggtatgcattcggttttccgcttcatcaaaggcaatgctggccgcagactcaaaaacctcgtcggtcacttccatcccgccatgtaaaccgtactcttcggccatttttttgccgagcgtggtttcgtcatcatggaacgcaggcagacaatgcaggaacttaacctgcggattgccggttaacgccatcatctggctgttgacctgataatcacgcagcagggcaatacgctccgcccatttctctttgggttcgcccatagagacccaaacatcggtatagataaaatccgcgccttttacgcccgaggcaatatcttcggtcagggtgatggcgccgccgttctttttcgccatggcgctgcactccgccactaacgcggcttgcggccagcaggcttttggcgcgaccagacggagatccaatcctgttaacgcggcggcttccagcatggagttacccatgttattgcgtgcgtctccggcatagaccaacgtcatctcgttaaaggctttacccggcagatgttcctgcatggtgagcagatccgccagtaattgcgttgggtgatactcatcggttaaaccgttccataccggcacaccggaatattcagccagcgtttcgacgatctcctggccatatcctcgatactgaataccgtcaaacatccggctcaggacgcgggcagtatctttgatggactccttatgaccgatctggctcccgctggaacccaggtacgtcacgcgcgccccctgatcgtatgcggcaacttcgaaagagcatcgtgtccgggtcgagtctttttcgaagatgagcgcaatatttttacccaccagcttttgttcttctttaccgtttttcttatcggctttcagtttggcagcaagctgcaacagagcagtgagttcactggcggtgaaatcaagtaactttaaaaaaggtttttggtaaaacgtagacatacttccctcacatggcttaggcctctcattgaattaaaattcactttatatggatgattattcatttgcaaccctgtttgataaaacttttctcgataaggtggaggcaacgtcggcggtatgtgacaataagagtatcggcaggacatctatgaggaacgagctatggcaaacccggaattactggaagagcagcgtgaagaaacgcggttaattattgaagagttacttgaggacggcagcgatccggatgcgctgtacactatcgagcatcacctttccgctgacgatttcgaaacgttggaaaaagccgcggtagaagcctttaaactcggctatgaagtgacggagccggaagagctggaagtggaagagggcgatacggttatttgttgcgacatcctcagcgagtgcgcgttgaacgccgaactcatcgacgctcaggttgagcaactgatgaacctggcggaaaaatatgatgtcgaatacgacggctggggaacctatttcgaagaccctaatggcgaagagggtgacgacgacgattatgtcgatgaagatgacgacggcgtgcgtcactaaagctgcatagtatgacggtacggcagcgtctgctgtcgtatttttttacaggttacgtatgaattacccgcaaatactctctccggtgcttaatttcctgcattgcccgacgccgcaggcgtggattgtccaggcccgcgatccgcaaaatcttcctcttctgcttaccgatcacttgatctgcgaactgaaggctgcgcaaaccgcgttgctgttggtgcgtaaatatgtcgccgataaatcgggcgccgacgcgctgctcgcctggctgcaaccttacgaggcgttcgcgtttcgtcaggggccggagccggattttgttgccctgcataaacagattagcaaaagcgccatgccgcaaactgatgacccctggggtcgtcagcttatcgaccgtatggtgttattgattaaagaggagttgcaccatttttggcaggtacgcgaggtcatgcaggccagaaacattccttatgtgaaaatcaccgccagccgctacgcaaaaggaatgttgaaagcggtacgcacgcacgaaccgctcaccttaattgataagctgatttgcggggcgtatatcgaagcccgctcctgcgaacgttttgccgctctggccccctggctggatgaggatttacagacgttttatctctcgcttctgcgctccgaagcgcggcattatcaggattacctggcgctggcgcagcagatttccgccgaggacatttctgcgcgcgtgcgctattttggcgacgtggaagctgaccttatcttgtcgccagaccgcgagtttcgttttcatagcggcgtgccagccgccggataaagcgtaaaattaaagattagcgtttttatcttttacgctgtcgccgtctgcaaaatttgtggtggtcatccgcccggcatcaagctgctggcgagcaggaaaagtcattttcatgatattctgtcctgagtaaagcctgccctgcggcaggcaaaaagaactcactcagtgttatattcccgaaaggtgaccgtgaacaatgccattattgcatcaatcactacgggtttttgtgttgaaatagttactgtttcacgccttttgacgcttcagagcaggtcttgccaacaaaggtttgtttaattttgttgatggaggttgttttattacctcctgcatcgacatccgatttcatggtcatcgcaaattctgtatcgcttattttcgtcgtttctacaatagagtgcgatttgacatcaggattattacacacagtctcattgatcagtttggtatccgtactttctacaaatgttgtcgtgcaaccgcctgcactggtagaaaaacccttcaccatttttttagaatcttcagacattttaggggtataacacataagcgtcgctatgcccgaatttttttcatccattaatacttcttttgtatctggattgatggtgcgcatttctatattttccattttccattcgccgggctgtatatctaatgcatatacattagagatactaataaacatagcggggaaaacaattgctgataataggcgtttcatttataacttccttgaataataagtgattcccggataacaggatgtttccgggattacttatatcagcaaaaataatacctggcgaggataaataaacgcctggttttcagagatcctttaacatcctcacttcgcaatcgacatgtccggtgcagccgagcggttcgctaatatgttcaaatcctaaacgttcgtatagcgcaatcgcctcgcgtaaaaaagccgttgtttccagatagcagcgtttaaaaccctgttcacgggcatgatccagcgccatcagcgccagctttttcgccagcccctgaccacgaattaccggtaaaaaatacattttttgcagttcacaaatgtctggttcgctacaggataacggcgccacgccgccgccgcccaccacacaaccgttttgctctaccacccagtaggccgcgcccggttggctataaacctgatacagttcatccagattggggtcggcaacggtataacctttatcggcggtaagtccgtattccgctgaaacctgacggatgacacgggcaatagcggcattgtcggcggtagtgattcggtgcaccgtgagcgttggcgaggcgacattattcataatatggctcaatttttaaaatttatttatagattactttaataccaccgtcttgagttacgcgcaaggagatcctgaatcagacaaaataaaaggcggaaaaattaaacaaaaatagtatcgtagtcaaatcagtaacaatttactggtttttattattaattctaatagattgtaattcagggatatgattcatgaataacgttatcagtagtaaagataaccataatcacacgttggtgtttacaggcaagggcggaaagtattttgttatttgccttgtgaatttcttgttgacgtgtatcacgtttggaatctatgcgccgtgggcgatggtgaaatgtcgacgttatatttatactaatatgacgctaaacaatcagccttttgcttacaaagccacgggcggcgcattatttattagtgtgttgttagtttttattatttatattgttagcctctcttttattgaacacggtcatcccggtctcggttttacgctattcggcttattaattgcgattattccttttatggcggtgaaaggattacagtatcaggcgatgatgacttcgcttaatggcgtacattttggattccagtgttccatgcggcgcgcctggtggtacatgttcgctcttccggtactcctgatggtggcgctttatattgttctttatattatctcactggtaaccatcgccgtcggcggtttagtgttcaatatcgtttttctcggtttgctggctattattgggataggggtcattaacggtattacctacagcaaatggatgaccttgtttggcaatggcgcaaactttggcattcatcgtttctcgattcaggttaatgttaaaacgtgcatcagagggtgcgtgttggcaatgttgaccctttttccttttgctgtcgtgattggttatctaatcgcgccggtgttcaccgacatgattcttttgagtatgatggggaatgcgcaggcaggaggggcgcttattctgcaatattatggccagataatggcatgttatttcctctattttctcgcgattattgtggtaaccagttacttatatgtggcgttacgcaacctgtttttaaacaatttgtcactggcgaacgattcgattcgttttcattcctctgtcactgcacacggtatgctgtggcggttactggtggtgtttgtgatttccggcgtgaccttagggctggcttatccgtggttgaaaatttggctggtgagctggctggcgcagaatacacaggtccagggcgatctggattcgcttgagttaaccaatgatgagaagccgctggaaaacagcccgctaatgtggatttctcgtggcatcatgccttacttcccgtttatctgatgtaaaaaggccgacgtttacgtcggcccataattcatgttgtcggatggtggcgtgaatgccttatccggcctaccgatcgcgccatgtcaataagcgaacgtgtaggcctggtaagcgaagcgccatcaggctttcagattacagcgcgctaataaccgcctgctgctcaatcagcttcgctttggcttctgcataaccgtccagcttctcacgctctttggcgatcaccgcttccggcgcgcgggcaacgaaaccttcgttggacagtttgccttcgatacgggcaatctcgccttcgattttcgccacttctttcgccagacgcgccagctcatcttctttgttgatgaggcccgccatcgggattagcagttcggcaccgtcgatgattttggtcatggaaaccggacctttgtcatcggctggcagcacggtgatgctttccagacgcgccaggttcagcaggaagctacggttgtcgttaacacgacgaacggcttcttcactacagccgcgcagcagcagttccagcggtttgcccggggcgatgttcatttccgcacgaatgttacgtacggcaacgatcgcctgcttcagccactcggtatcggccaacgcggcttcatccacctgcgcggcgttatattccgggaacggctgcagcataatggtatcggcggtaatgccacagataaccttcacgcgctgccagatggtttcggtgatgaacggaatgatcgggtgcgccagacgcagcaaaccttccagcacggtgaccagcgtatggcgggtgccacgcagttcagactcggaacccccggtcattaccggtttggtcagctccagataccagtcgcagaactggttccaggtgaactcgtacaggatgcctgcggcgatatcgaagcggaagttatccagtgcttcgcggtaggctttaacggtctggttgaattccgccaggatccagcggtccgccagcgacagggtcatttcgccgccgttgaagccgcaatcctgctcttcagtgttcatcagcacaaagcggctggcgttccacagcttgttacagaagttacggtagccttccagacgcttcatatcccagttgatgtcgcggccggtcgaggctagcgccgccagggtaaagcgcagggcgtcggtgccgtgcggctcgatgccgttcgggaactgcttctcggtacgcttgcggattttctccgccatctgcggctgcatcatgttgccggtgcgtttctccagcagttccggcagggagatgccgtccaccatatccagcgggtcgataacgttacccttggatttggacatcttctggccttcgtcgtcgcgaatcagaccggtcatgtagacagtatggaacggcacctgcggcttgccgttttcatctttgatgaagtgcatggtcatcatgatcatgcgggcaatccagaagaagatgatatcgaagccggacaccatcacgctggtgggatggaactgacgcagggcgtcggtgttttctggccagccgagggtggagaaggtccacagcgcggaggagaaccaggtatcaagaacgtcttcgtcctgacgaagctgaacgtcggcaccgaggttattttcctgacgcacttcgtcttcggtacggccaacgtagacgttgccgtcgttgtcataccatgccgggatacggtgaccccaccacagctgacgagagatacaccagtcctgaatatcgcgcatccaggagaagtacatgttttcgtactgcttcggcacgaactgaatgtcgccgttttcaaccgcttccaccgccggtttcgccagcacgtctgcacggacgtaccactggtcggtcagcatcggttcgataactacgccgccacggtcgccgtaagggacggtcagatcgtgcggtttaatttcttccagcaggcccagcgcgtcaacggcagcaacgatggccttacgggcagcaaagcgttccagcttctggaactcagccggaatctcgctggaataaacgttagactcttcacctttggtatcgaacacttccgcgctttcgcgaatgtcgccatcaaaggtcaggatgttgatcatcggcagggcgtgacgtttcccgacttcatagtcgttaaagtcgtgcgccggggtgatcttcacgcagccggtacctttttccatatcggcgtgttcgtcgcccacaatcggaatgcggcggttaaccagcggcagaataacgaatttgccaataagatccttataacgcggatcttccgggttcacggccacgccggtatcgcccagtacggtttccggacgggtggtggcgacgaccaggtaatctttaccgtctgcggttttcgcgccgtcggccagcggatagcggatgtgccacatcgagcctttggactcgcggttttccacttccaggtcagagatggcggtgcgcagcttcggatcccagttcaccaggcgtttgccacggtaaatcaggtcttctttgtacaggcggacaaagacttctttcacggcattggaaaggccttcgtccatggtgaagcgctcgcgctcccagtcaacggagttgccgagacggcgcatctgacgggtaatggtgccgccggattccgctttccactgccagattttgtcgataaacgcatcgcggccgtagtcgtgacgggttttaccttcttcagcggcaatcttgcgctcaaccaccatctgggttgcgatcccggcgtggtcggtgccgacctgccacagggtgtttttaccctgcatacgctggtaacggatcatggtatccatgatggtttgctggaaagcatgtcccatatgcaaactgccggtgacgttcggcggcgggatcatgatgcagaaggactctttgctttcgtcgccgttaggcttgaaatagccctgcttttcccagtgctcgtaaagcggctgttcgatatcttgggggttatatgtcttttccattatttccaggttgccgtattcaggttaaaaccagccacgcggtaggctttgtagcgttcgcgcgccagttgtttcaaagtttcttcgtaagggacgaagtctaccacttctgtgaaagcggtggcaaaatctgcaaagcttgtacgcaggctgattaaaatatcgcgcgggctgctgttgcgtttttgcggccaggcgatttcaaccggcgcgccgccgcgtgggccttcgcctgccagattgtgcgggacaaaactttccgccggtcttgcccacagcgcttcatccagccgaatggcctgcttctcatcttcgcaggcgatcagcacgcgcttgccagcgcgccaacgttctgcggcaatttcacacaccagttgttcaacggcgcttaaaccgttgacggtggtgtcattgtccagaagatagaacgtcgcattcttcatatatgaggcttcttgtggtggatttaaatgcgttgccatgatgcaccccgtaggccggataagcgtggcgccatccggcaaaacgcctgatggtggcgctaatgcgccttatcaggcctacggggtaatctcaaacttactcttcgccgttaaagcccgcacgattgagcaggaactgcgacagcagcgctaccggacgaccggtggcacctttggctttaccggaacgccaggcggtaccggcgatatccaggtgcgcccagttgtacttacgggtaaagcgcgacaggaagcagcccgcggtgatagcgccgccaggacgaccaccaatgttcgccatatccgcaaagttggactccagttgttcctggaactcatcgcccagcggcagacgccacgcgcggtcgcccgcttgctcggacgcgccgatcagttcatgcgccagcgggttatggttcgacatcagaccggtaatgtgatggcccagcgcaatcacgcaggcgccggttagcgtcgcgacgtcaatgaccgcttccggttcgaagcgctcaacgtaggtcagcacgtcgcacaaaaccagacggccttcggcgtcggtgttcaggacttcaacggtttgatcagacatagtggtcagcacgtcgccagggcgataagcgcgtccgcccggcatgttttcacagcccgccagtacgccgataacgttaatcggaagcttaagctcggcgaccatacgcatcacgccgtaaaccgccgccgcgccgcacatgtcgtacttcatctcgtccatcccttcagatggcttgatggagatgccgccggagtcgaaggtcaggcctttacctaccagcacgatcgggcgcgcgtcttcggacggattgcccttgtactcaatcaccgacatcagcgattcattctgcgaaccgtggccgaccgccagataagcgttcatacccagttcgcgcatttgctgttcgccgatcacgcgggtgatgacatttttgctgtagctgtcggccaactggcgcgcctgtgacgccaggtaggcggcgttacagatattgggcggcatgttgccgagatctttcgcagccttaatcccggcggcgatggccagaccgtgctgaatggcgcgttcgccgctggtgagctcacggcgggtcggcacattaaagaccatcttacgtagcgggcggcgcggctcgctcttgttggtcttgagttgatcaaagctataaagcgtctctttggccgtttcgacggcctgacgcactttccagtagttgttgcggcctttaacgtgcagttcggtcaggaaacagacggcttccatcgaaccagtatcattcagagtatttatcgttttctgaataacctgcttatactgacgttcatcaagctcgcgctctttgccgcaaccaatgaggaggattcgctcggaaagaacgttaggaacatggtgcagcaacagagtctgccccggttttccttccagttcgccgcgacgcagcaatgcgctgatgtatccgtcgctaattttgtcgagctgttctgcaatcggagaaaggcgacgcggttcaaagacgcccacgacaatgcaggcactccgctgtttctccgggctaccgctttttacactgaactccatgcactatgctcctgaatcttaaagacaacagtggtggctacagctatactcgtcgtctttcaagttgcagatgcgttggctgcgcctgctcatccctgtcgcttacctgatgtaagctccggggctccacagtcctgccgcctgcctgcaactcgaaatccattagagtatagaaattgaaagctttcgtaactcatatccgctgttgcggtgacttcgtgttaatcttaacgttattacggcattggcacgtcagaacaagttctgagaggtgaatccgctgagtataatgatcttagcgatgatttcgacgactcaagagaataaatgacgtttaagccatgaaacaagctaaattccagcaaaaaaatggttttttacgggcgtatttaaagtgataatcataagatatctggtgcgggagacgctcaaaagccagctggcgatactcttcatcttacttttgatcttcttttgtcaaaagttagtgaggattctcggcgcggcggttgacggcgatattcccgcaaatctggtgctctcgcttctggggctgggcgtaccggaaatggcgcagctcatcctgcctttaagcctgttcctggggctgctgatgacgctgggcaaactgtataccgaaagtgaaattacggtcatgcacgcctgtgggttgagcaaagccgtgctggtaaaggccgccatggtactggcgttatttaccggtatccttgcggcggttaacgtgatgtgggccggcccctggtcgtcaaaacaccaggatgaagtgctggcggaggcgaaagcgaaccccggtatggcggcgttggcgcaggggcaattccagcaggcgaccaacggcagctcggtgctgtttatcgaaagcgttgacggcagcgacttccacgatgttttcctggcgcaaattcgtcctaagggcaatgctcgtccttctgtggtagtggccgattccggacaccttactcagttgcgcgatggttcccaggttgtcaccttaaacaaagggacgcgttttgaagggacggcgttgctacgcgattttcgcatcaccgacttccagaactatcaggcgattattggtcatcaggccgtggcgctggacccgaacgataccgaccagatggacatgcgcacgctgtggaataccgacaacgatcgcgctcgcgccgagctgcactggcgtatcacgttagtctttaccgtatttatgatggcgctgatggtcgtgccgctcagcgtggtgaatccacgtcaggggcgcgtcttgtctatgttgcccgctatgctgctttatctgctgttcttcctgatccagacctccattaaatcgaatggcggtaaaggcaaactggacccggttatctggatgtgggcggtcaacctgatctatctggcgttggcgattggtttaaacctgtgggatacggtgccggttcgccgcctgcgtgcccgttttctgcgtaaaggagcggtataatgcagccatttggtgtgcttgaccgctatatcggtaaaaccatttttaccaccatcatgatgacgttgttcatgctggtgtcgctctccgggatcatcaagtttgtcgatcagctgaaaaaagcggggcagggtaactacgacgcgctgggcgcgggtatgtacaccctgctcagcgtacctaaggatatccagatcttctttcctatggcggcgctgcttggcgcgctgctggggctggggatgctggcgcagcgtagcgaactggtggtgatgcaggcatcgggtttcacccgtatgcaggtggcgctgtcggtgatgaaaacggctatccccctggtgctgttaaccatggcgatcggcgaatgggtcgccccgcagggcgagcagatggcgcgtaactatcgtgcgcaggcgatgtatggcggctcgctgctttccacccagcaaggtctgtgggcgaaagacgggaataactttgtctatattgaacgggtgaagggcgacgaggagctggccggcattagtatttacgctttcaacgatcagcgtcgtttgcagtcggtgcgttacgccgcttcggcaaaattcgacccggagcataaggtctggcgtttgtcgcaggtggatgagtccgatctgcaaaacccgaaacagatcatcggttcgcagacggtgagcggcacctggaaaacgaatctgacgccggataagttaggcgtggtggcgctggacccggatgcgctttccatcagcggtctgcataactacgttaaatatctgaagtcgagcggacaggacgctggacgttatcagttcaatatgtggagtaaaatcttccagccgctctccgtggcggtgatgatgctgatggcgctgtcgtttattttcgggccgctacgtagtgtgccgatgggcgtgcgtgtggtgacggggattagcttcggcttcgtcttttacgtcctcgaccagatttttggcccgctgacgctggtatacggcattccgccgattgtcggcgctctgctgccgagcgcgtctttcttcctgattagcctgtggctaatgctgcgtaagtcgtaatcacagtaatcgtaggcctgatggcgctgtgcttttcaggcctactccggacccgtaggccggataaggcgttagcgccgccatccggcagacagcttggtattcctcgaatgatgtagcgcgtaacctgacgcgtggcgcttttggctacgcgttaagcacaggcaagctgcgggaaagagcataagcgcagtagttcaaaaagttataatgtgttgccgtgataaatctgataacccaaatcaatcgtattatggttgagatcgttatttttaattttgttgagcaacatctgcgcggctctgcgcccgatctcaaaacgaggggtaattacgctggcgaggctcggtatcatttgcctgcccatctccagaccgtggaagccggcgatggagatctgctccggtacggccagttgacgctcgcggcaccacagtagagcgcccattgcgatatcgtcatttgtacaaaagacgccatccacgtccgggtgcgcagtaagcgcatcacgcattagctgtatccccagatggatagaggagatagcgcggggattgatgcgcaacggcgctagcccccggcgcgtcatcgcatcgcagtagccgtgataacgctgctcatcacggatatcgtcttttgaacccagatagagaattttccgccgctggcgtttatccagcatggtgctgaccatatcaaaggcggcctgacggttatcaaaccccacctccatatctaagcgatcgccctggatatccatgagttctacaatcggaagggtagctgagcgcaggaatttgacggttctgagggtatgatatttttctgaaagaataatgccgtcgatattgtaagacagtaaattgataacggactcttcttccgaatcgcgattgtaattgtaattcgcaatgagagtttggtagttatgacccgacgttacggattcaatcccggcgagaatgtcggcaaacaactgattctgaaaagaggggatcagcacgcccagagtgtaactttgcgcgtttaacagcatagcaggcgcgcgatttggtatgtagttaatttcctccatgatctgcgcaatacgctcgccggtttccctggcgacttttttcggcgagcggatgtaacggctcaccgtcatttttgtcacgccagcaagcgtagcgatatcctgcaaagaaattctgtgattcctcatgttttctccagtaccgggggcgggaacgtcgcccccatggttaattgggctgcggatgatgaattaatgcagaaccgcattcagcgccagtacgcccagcaaccccatgacagaaatcaatgtttccataacggtccaggtgcgtagggtttccccgacgctaagattaaaataccctttaaacagccaaaaaccgggatcgttaacatgtgatgcaataacgcttcccgcgcctgtcgccagtaccattaacgccggatcggcgtgggttacgttaataatcggcaatacgacgcccgctgtggttatcgcggccacggtcgcggaacctaacgcaatacgcagcacggcggctaccgtccagcacattaataacggagatagcgaggtgccggtcattaattgcgagatatattgacccacgccgctatccaccagcacttgcttaaacgcgccgccgcccgcgatgataaaaacaatcatcgcaatagcgccaatggactcgccgacgatatccatcacctgctcaaccgtacgtccattgcgtcgccccagcgtaaaaatggcgatgataatggcaataaacaacgccactgctggattaccgataaattcgaagaaaacccgcacggcattcgtttttggcagcgtgatttcacataccgctgcgatggccatcagaatgaccgggatcacggcggcaaaaatactgttccagaatgacggcatctcctcttcactgaatagatgaggattaaataatccttcaggcggcgctttttcaaatcgcgccagcaattttgaaaacagagggccggcaacaatcacggtcggtatggtaatgattaacccatacagcagggtcgtaccgagatttgcctcaaaaattgtcgcaatagcggtagggccgggatgcggcggcaggaagcagtgcgtaacggataaggcggcgaccattggaaccccgacatacagcaatggcagtcccgatgaggccacaattgtaaaaacgagcggcaacagcagtacgaatccgacttcaaaaaacattgccaggccgacgataagcccggtgatcaccagcgcccattgcacgcgttttttgccgaacgtattaatgagcgtcgtcgcaatgcgctgcgcggcgccggtatcggaaattaatcttcccagcatcgcgccaaaaccgccacgattgaggatagtgggcactgccccttccaggcagttaatttgattgccgctgatacaggcatcgcagtgtccgcagctgcgcgccgtccagccgattccaacgcgctggccgacttttagtcccttatcctgtgccgcgctaccgagtgcggccacccgaccgatgacctcgtgtccggcaaccagagggtattgagagaacccccattcattgtcgatcatcgacagatcggaatggcagatcccgcagtagtcgacccgtacctcgacatcttccggttggagttctcccgcgtcatattcatagagttcgagctcgccgcccgcctctttggcggcgtagctttttattatcgtcattgtgcttcccttaatgtggtgttgaactgaaaagtgtagagcatggaggcaagggacgcccggcgttaatctgctggagaaggcgggaagtagcctgattattctatttaatcctcaacgctgctgaaattttcagcacttagcgatacaggtgtatgctcgtgcttgcatggcggcgtatgacaggtataatccacaacgttttccgcatacctcttcagtgccgaagtggcgaaatcggtagacgcagttgattcaaaatcaaccgtagaaatacgtgccggttcgagtccggccttcggcaccattagtacttccaagaccatccgagaaagtccaattatcccttaaaaatcaatgattgaagcgatttttacgtcctgagtcgtccgaggttgtccgttgaaatccggaagtcattgggggcataattgggggcatcttaacttcgattagaaatgtgcccccaaatgaagctcaacgccagacaggtcgagaccgcaaagccaaaagacaaaacctacaaaatggccgatggcggcggtttgtaccttgaggtttcggccaagggatccaaatactggcgcatgaaatacagacgcccctctgacaaaaaagaggatcgcctcgcttttggtgtttggcctactgtgacacttgctcaggcaagagcaaagcgcgatgaagccaaaaagttgctagtgcagggcattgatccaaaaaccgaacagaaagaggctcaggccgagaactcgggggcgtatactttcgaaactatcgctcgtgaatggcatgccagtaacaagcgctggagcgaagaccatcgatcgcgcgttcttcgctatcttgaactttatattttccctcatatcggttcgtccgacattcgccagctcaaaaccagtcacctgttagccccgatcaaaaaagttgatgccagtggtaaacacgacgtcgctcagcgcctgcaacagcgcgtcacggctattatgcgttatgccgtacagaacgattacatcgactctaatccagccagtgacatggccggtgcgttatcgactaccaaagcacgacactatccagccttaccttctagccgtttccctgagtttcttgctcgccttgctgcatatcgtggccgtgtaatgacacggattgctgtcgagctttccttactaacttttgtacgttccagcgagttacgtttcgcgcgttgggacgagttcgacttcgataaatccctttggcgcgtaccggcaaaacgagaagaaattaagggtgtgcgttattcgtaccgtggcatgaagatgaaagaggagcatatcgttcctctcagtcggcaggcgatggttttgttagagcagctcaagcagattagtggtgataaagagctgttgtttccgggggatcacgacgcaactaaggttatgagcgaaaacacggtaaatagcgcattgcgtgcgatgggttatgacacaaaaaccgaggtctgcgggcatgggtttcggacgatggcgcgtggtgctttgggtgagtcaggattatggagcgatgacgcgatagagcgtcagttaagccattctgagcgtaacaatgtgcgtgctgcctatattcacacttcagagcatttggatgagcgtcgtttgatggtgcagtggtgggctgattatctcgatattattcagtatgagcatattacaccttatgaatatgcaagagtctgcaacataaaatgaatgatatttatagatgataatttaatggattaaaataggcacaattacttgtgcctattaattcaatctttccaaagaattacagggtgtgctctaggccatgggtgtccatcaaaagtggaataacaaacagtatttcttgttgaggtgtttgggtacctcgaaccgtatacactttccatactaaaaaaggagttagaaggtgtcccatcaataaatccacttatccctccttgaataagattattgacgcgaccgacatgacgttcttcggataaataacaaagggtttcacatgccttaacaagcgtttcagctgtaggcctcttgtccgagtcataacttaagcacttatctacaattttttgtagatcttgtgataaactttgatattgtggattggcagtcataaaggttggccattccattctattttttgttttaacattaacagcagcatctaaataaacgccaaatggatagtctcctgttaataatttaaacatcattgcacctaatggccaaatatcagttgatgcttctataggtttaccctttttaccaaacattaattcaggagacatgaagggtaaagcaccttttatcgtaccagaggtcgatcttgttaggtcaccactggcagcagcttcatcaaaaagttcttgtgttagcgtagctattccaaaatctgtaatttttagattcgaaatttgtactccgccagacaccattacattactcggttttaaatctctatgaataacatctgctttatgagatgccattattcctttagcaaggttatgtagtatacaagcgccataatgtgggtctaaaaaatcaaagtggcgcaatttttcctcaaggttttcaccttcaacaaattcttccgctaaaaatatattgccattatcttcaacataatcaaaggtttttgctatattgtgatggtttatttttgcagcgattttggcacttttaagaaatcttttgctttccaaaccaggaagtggagtctttaaagctaaatctaaatccagctttagatctaaaactttatatacgtcttgcatcccacctttaccaacataagataaaatcttatagcgttctgcaatgattcttccgacttcaatcatgatattacctccggtctagatatatcaaaggtgacaaagcttctagatttttcatttataagagtaattacactgcagctaggaaatactttatttgttatcacttgttggttattaattgtcgcacttcctgaaaaattacctactttaaagtcgaaaccatcatatactatttccatacttccactagtaccccaagtgatcgtaacacttttatttttagcatttatttcatatttctttccattcaggacgaagagggcacggtgtctatcttttaataggtatttagctatttgatctctaaccgaagacattgccggtcgagcatatttgtcatggcttaagcaactaatgaaagttctggctaagtcctttggaagtatctttcctaattcaggtatattggttatcgcggccgggggatgttcgtataattcatctggtttttctatgccgaataaatctaaaacgaggacaccatatgcataaacatcaattttttgatcgaaactaatgttttttctcttccatagttcaggagccatatatcctaaggttccaataacagaatgagtgaatgcttctgtgcctgaggtccttgctaaaccaaaatctaatattttaacaattttattctcgtctactctaatattattgggctttatatctctgtgaattactttagcagagtggatgtcacttaacccgcatgctatctgccataatttctttagtttttcggggtgactttctgacgggttataatttaaatccactccgttaatatactccagaactaatccttttttagttttttcggagactgttatgtcaattaaatcataaagttgtactacatgtttagaacgaagtttgagtagcgctttctgttcatctagtaaacgtctctcttcttctccatcctttaacaactttacaattacatctctatctaaatgattatccttacatattaaaatgtcccccatgccaccaccgagttcagtgctctttaatgaatatctttctggtaggacgtgattaatcttcatttttgttttcctcatccttgatatttatcattacagattggtcttttttgatcttttcaatagctttctttttatctttgttttttctttgtttgattgctttgcttgtaatggatggatcttgagatttttctggggattcgtttgagaatagctctctttgtggtgtttcagaatctaattctagattttttgttgaaggattgtttagtgtttttttattttcaaaaccatcatcgtctataataggtgaaggttctttatcttgatcatccactatattttgagagaagtaattctgcgctgcaggataatttttcatccacatgatatgtagattcccataagggtcccataactctacaccaatatctttatgggagttgaggctgttttctatatcattgcaattaataattccaaatgaagcgttatctttcgcaccgcaccattgaacatattgagctattctctgcgctgatgtagaaaaatcagatgaatgacttaataactcttcgaatgctgaatgagaaatgaaatgagttccatcggatgtcaatattatatttttatgatttttatctaagatattgatatgaggctttatagattcccccattcctataaactggagtaatccgcgccctctgccacccaatgcttctagagagtcatcactgctaattgctgtaagtccacagtccagagaaaagctatatattcgactgtcgccaacgttgacaattacaggagcagacccattttcaataattacagcggataatgttgaaccgccatgtccttttgcatagtcatatacaacggagtttgcttctaaagtcgcttttaataaccgagactcgggaggatcacttctaaacttaatcaaagaatagaataaagttgataaagcaattgttgcgcattgctttccatcttgcattccacccatgccatctaataacgccattgcaaaaaaaggattgccaacgtttgacggagtgttaactctaatcgcggctattagatcctgattctcagctctaaccagtcctatatccgtgctaaggacagcgttgaggtcttctggccggttaatgccgcttttggccgaagaacgagctaaccagcgagcaagtcgttctgtaaacatagtaattccgttttattgtgggggagtttactttcgcaatgagctaaccaattgtcaattaatacgaaagagctcgcgcgcaatgctctccccgccacgcctgcccgcttaagaggtcgcttttaatgcaggtgcatgaacgtcctcaggccgcaccagcactggtgttgcgtgggataaaaaatacggggatttgcatgcaaaaccatgcaccttatggatgcatggcttttttcaggaaaaatagcggaattttcgggggattttttcgcgtactaccgtgtggccagttctgcacgtcggcgggtgtaaatcaggttctgtgccggagtgaatttctcgcgattatcatcccgcgaagccgcatcaggcctgaatccgatggtcgttaacatatcgttgtcctgcacggaataattaattttttcacctgcggccagccacaccgacagggcttcacgcagataatcaaccgagtgctgcatggcgctctgttttactgcgggaatttgttcgtgatatcccatcagctcaggcgccagcgtggcggccagctccgcgccgtgctgctgcataaagtcatggagccggttgcggatgctgatgtgctgtacctcctcatgtgagcggatatagcgaccggcggcctgattaatctcccactttttcacgtcgatattgtcgcgcaaatcctgcattctgcgcgggatttgttcgtcaccggcaaggagctgttcacggtattcccgttcaaggtctgccagttcggctttacgtttcagccaggtatttttgttcgtctgacaggcctcaaaggcctgttgtatggtcacagtggtcacgagtctctctcctgattaatgccgaaacggcgagctgtagcagccctgtactttacgcggcggcggtggcgtcaccggcgcggggtcgggtttctccggtgcagcacgtatcacaccgtcaaccgactcaatggtgcggaaagtggccgaacattcgatattggtacactggtgataacgctgtttgacgttttccgacagataccggctggtacggacgtgcgcggtctttttgcagaacggacagtgaaacataattcagccctctgcctgttcgtggtcttttgcggccagttcagcggcaagcttcatccgtctggccgggcttcttaacagcgccatatcaaccccggttatgaccgggcgattcatgcccgttacggacagaaccggctcctgctccatatcaaaatgatacagggctgactgcatattcagggcatcacccagctcacgggtcacggtcgcacgcagcgaggtttctccgctcatttccagcgaccgaatacgcaacagaaaggcacgtaacagtgcggggctgataccggctaacgccttcttccactcgctgttggcgtaggtagtgaacgctttttcatgggcgctgatataagccgtaccggaggagcatgcaccaagcatggcgaggcttttgtctttctccagctcggtaatcagaccggtgaactcatcagccagttcgcggctggcgatacgtttactgtgttcagctttcagttcaggagtgaggttgccgcgcagagttcgaaagcggctgcgccagtcctgttcggcctgtgcactttcactgagggcggtctgtcgttcctgctcacaacgctgaatggaagcctcaatgtcgctgagtttacccatgctggccgtgtgtgcgtcttttgcttcgttaagtgcgaccagcgcaccggcaatgcgttgttccgcgccttcatcctgtttactgataacggtctgcatggatttgataatgagttcgggtttcatgttcaggctctccgtgtgttcaacctgaaatgattctgacgcctcctgcacaacaacacgattcattgccgttgtcagagtgctggcacaaacagaccttaaaaaccggctggccacagaaaggtctcaggaaaacctgactcaccgtttgtttttttactaataactattcaccactgttcaccttaaataaaaagataagtaatacagtgagttaaagggtgaatagttgaaggtctgagtgttcaccgtctgttcaccactgttcacccttcactttgttcagccagccagcttcttagattttttagcgattaaaaaaagaaatatataaacaaaagtaatcagcaatgggccaccggtttgccaacgtttgccaaaaaacggccaacgtttgccactgtataaaaatcgctctgttgtgtggtggagtactacaaaatgacttgttgccctgcgtaaaaatattcacaaaatagagagctacccgaagccggacggacacgaccggcactgtatggactttgtgaggtagcccgatgcacaccgctttttcttccccgtcttctgcccctgccgcgccgctgatgccggtttctgataccgttcatgagcgttttattcgtctgcccgaagtgatgcatctgtgcggtctgtcccgctcgaccatttacgacctcatcagccgggaagccttcccgaaacaaatctccctcggcggaaaaaacgtggcgtgggcgcagtctgaaatcacggcatggatgactgaccgcatcgcaaccggggttatgacgcatgatgatgaccattcagcaaacagcccctttttctggcttgcttctttttatcgtttccaggtatagttttcccgctgtcgcaaaatcggcagccgggcgtggaaacccgagtaatctaacggcgacacctgacgcgccatgcgtctttttttgtgtctatgccctcgtgcacctgttacttgcgcaatggtttcatgacctttgcagctatcgagtaatggtggctcaggcggggccgacttcggtcgggccggtatccgttagagccggtatttccacccccgtctgggctaccaccactgagcgtggaaactccggtggtagcataacctgctatctaacggaggttgcccttatggctacgatcctcaccccgtcatacccgcagtttgtctttgtgtttgccgctgttcgtcgcgcagaccgtaaaccccgtatctgtatgcttcgcaccgttgccggtgatgaacaggccgcacgtctttccctcgttcgcgattacgtcctctcgttcgctggtcgtctgccggttgcggaggtgcgcgcatgagacacaccaccattaccgcccgtgacctcgaatgtctggagcatatgcgcaacgtcggccagctcgtcaatgagctgatgcaggtgcaggactgcgccaccgttcgtcgcgacccggtgcagcagtcacagctcacctcggtgatttacctcatgaccgcccagcttgacggcgtggtagagcgctgcaatcagcgctggctgaccggggagggcaacgtatgaaaaatccattaccgcccgtattacgcgccgcgctgtatcgtcgcgccgtggcctgtgcctggctgaccctgtgcgaacgccagcaccgctatccgcacctcaccctcgacgcgctggaaagcgccattgccgccgagctggagggcttctacctgcgccagcacggagaggaaaaaggccgccagattgcctgtgcactgctggaagatttaatagaagccgggccacttaaggccgcaccgtcgctgtcctttctcgggctgaccgtgatggatgagctttgcgcccgtcatatcaccgcaccggtactgcactgagggagaaaataaacatgaaaatgaacgtaacggaaacggtaaaacaagcctgcggccactggtcgcgtattctcccggcgctgggtgtgaaggtgattaaaaaccgccatcaggcctgtccggtgtgcggcggctctgaccgtttccgctttgacgataaagagggacgcgggacgtggttctgcaaccagtgcggcgcgggtgacgggcttaagctggttgagaaggtatttggcgtgtcggcctccgaggccgccggaaaggtggatgccgtgaccggcaacctgccgccggttgccctggaagtgattgcggccgcagaagcagaaacggaggctgaccgcaaagcggcggccgcgctggccgtaaagctcatggagaaaacccgaccggccagcggcaacgcctacctcacccgcaagggattccccggtcatgagtgtgtcatgctgacggccacacacaaaaccggcggcgtgacgttccgcgccggtgatatggttgtcccgctgtatgacaatgccggggcgctggttaacgttcagcttattaattctgacggtctcaaacgcaccctgaaaggcggggcggtaaaaggagcgtgtcacaccatcgaagggaaaaacaggcgggaaaacgcctgtgggttgcggagggctatgcgaccgcgctcaccgtacatcacctgaccggggaaaccgtcatggtggcgctgtcctccgtgaacctactttctctggcgagccttgcccgtcagaaacacccggcctgtcagattgtcctcgccgccgaccgtgaccttaacggcaacggccagagtaaagccgctgcggccgcagacgcctgcgagggcattgtcgccctgccgccggtgttcggtgactggaatgatgcgtttatgcagaaaggtgaagaggccacgcggaaagccatttatgacgccatccggcctccggctgacagccctttcactaccatgagcgaagcggaatttaccgccatgagcaccagtgaaaaggcaatgcgggtgcatgaacattacggcgaagcgctggccgtggatgcgaacggccagctcctgtcccgatatgaggcaggaatatggaaaatcattcccccgtcggattttgcccgcgacgtggccgggttgtttcagcgtctgcgcgccccgttctcgtcggggaaaattgcctcagtggtggagaccctgaaactgattattccgcagcaggacgcaccggcgcgccgtctgattggttttcgtaacggggtactcgataccgccaccggcactttcagcccgcaccacaaatcgcactggctgcgcacgctatgtgatgttgatttcacctcaccggtggagggcgaaacgctggaaacccacgcccctcatttctggcgctggcttgaccgcgctgccggtggcaaaccggaaaaacgcgatgtgattctggccgcgctgtttatggttctggcgaaccgttacgactggcagctctttctcgaagtcaccggccccggcgggagcggaaaaagtattctggccgaaattgcgaccatgcttgccggggaagataacgccacgtcggccaccatcgaaacgctggaatcaccccgcgaacgcgctgcgctgattggcttctctctgatacgactgcctgaccaggaaaaatggagcggtgacggggcaggactcaaggccatcaccggcggggatgcggtctccgttgacccgaaatacaaggatgcgtactccacccatattccagcggtgattctggccgtgaacaataacccgatgcgctttaccgaccgcagcggtggtgtatcgcgccgccgggtgattattcacttcccggagcagattgccccggaggaacgcgacccgcagctcagggataaaattgcgcgcgagctggccatcattgtgcgtcagcttatgcagaagttcagcgacccgatgacagcgcgcacactgctccagtcacagcagaactccgacgaggcactcagtatcaagcgcgatgctgacccgacgtttgatttttgcggctatctggaaatgctcccgcagaccaacgggatgtttatgggtaatgccagtattatcccgcgtaattaccgtaaatatctttatcacgcgtatctggcctatatggaggctaacgggtacaggaacgtgctcagcctgaaaatgttcgggctggggctgcccatgatgctgaaagaatacggcctgaattatgagaagcggcacacaaagcaggggatacaaaccaatctgtcgctgaaagaggaaagctacggcgactggctgccgaaatgcgaggaacccgcagcaacataaccaactccagaccggcaacagccggtctttttctttctggacattgccacagggtgaacactccactgttcacccttcaccgtatattcaccctgtatcaccatgaaattattgataaaaaaccagaggtgaacagtgtgaacaataaaacctgaaaaaactttttatcaccctgcgcatcgcctgaccaggcgcatccaggacgagcaaaaatcacaaatgtgaagagtcgattgttcactcttcaccaactcatcaccacttatcaccatgatattaaaaagaaaagtgaagaggtgaacagtgtgaacagttatatggaaaaaaagaattttactgatgttcaatattaccccggttaggatccgtatatcggaacctaaccgatggggaaaataacaatttcctttttaataccaatcagttgtgaacttaaggggcttaaaaagccatgggggcacaaaagggggcacatgaacatgtgttcttctttatttcctttattttcaatttattatgttgtgttttgagtccggccttcgcaccatacaaagcttttttcaagtctactaacgtctactttaatccacaaaaacagtaagttaagcgaatttctgacttggcttagtctgttcacgtctactcaattccttgaacatataccaaccgatgatggtataactgatggtattcccggttcgattgattttggtaccaacactggaggtatcaactgatggctctcaccgatatcaaagttaggactaccaagccctccgacaaacccttcaaactcacagatgggcagggtatgcacctgctgatcaaccccaatggttcaaaatactggcaactccaataccgtttcgggggtaaactgatcctacccgcgtaatagggatacaaccttaagcgcggttctggttttcaaattgttccggactgagaccgccacaggcactgtggcgacgccagcgattgtaatcgcactcaatataattaaacactgctgcccgcattatttcccggctggcaaagtcctctccatgcatacattccaccttcagcgtgtggaagaagctttccgcacaggcattatcgtaacaacagcctctggcgctcatcctgccccgcagattatgccgtttcagtaagctctggtaatccgctgaacagtacttactgcctctgtctgtatatatggtgacttttccggtcgtttacgccgccacagcgctatgtgtaatgcatcgcaggcaaactgtgccgtcatccgcgaggacatagaccagccagtggctgactgcggccacaggtcaataaccacggccagataaagccagccttcaccggtgcgaagatacatgatgtcacccacccatttctgattcgggccactgacgtaaaagtcctgcttcagcagattctctggactggcagaccatgttcgcggtaactgactggactgatcttccgtgaagctttcgcccgcagcgcctgccggcgcaggctggccgctacggtatacacccgtccctgagcacgaagctcatccgtcaggcgtggcgcaccatagcgctgtttgcgtcactgaatgcctcccgggcgacgttatcacagacaaggcggaactgctgacgctggtttatctgatgacgacgctgatgccagacgtaccagccactacgggcaacctgaagtacacggcacatggctttgatactgaactcagcctgatgtttttcgatgaagacatacttcatttcaggcgtttcgcgaagtatgtcgcgaccttctggagaatagtcagttcctcatcccgttctgccagttgatgcttcagacggacgatctctgcggacatctcctattcgcgttcagaagaagagagctgattttgctgttttcttcgccagttgtagagctgcgattcatacaggttaagctcgctggtagccgcagccatcccaatgcgttagccagtttcaaggcttcgtcgcgaaattcaggcgtatgttgcttgcatggctttttggtggttgatgctgcttttgtcatgtgagacacctctttcttgagagtttactcacttagtcgcatgtccactcttgctgggtaagatcagacaacccattctctcaataaataacataaacatttttatttggatgtatttttttgtttatgctttttaaataaagggttgatatgaaattttttaaacatgtggatattagatattccacaaaaagtattaatggatcattcgcttattaatggggggggcgtgtaaagataaaaaaatagtgatccttgttttttgcttaaatttttaaaatggcgtgagtatattagcatccgcacagataaattgtgcgaatgctaatagttgatttttggagattttgtaatatgcgtaaatcagcatctgcagtagcagttcttgctttaattgcatgtggcagtgcccacgcagctggctttgttggtaacaaagcagaggttcaggcagcggttactattgcagctcagaatacaacatcagccaactggagtcaggatcctggctttacagggcctgatgttgctgctggtcagaaagttggtactctcagcattactgctactggtccacataactcagtatctattgcaggtaaggggcttcggtatctggtggtgtagccactgtcccgttcgttgatggacaaggacagcctgttttccgtgggtatattcagggagccaatattaatgaccaagcaaatactggaattgacgggcttgcaggttggcgagttgccagctctcaagaaacgctaaatgtccctgtcacaacctttggtaaatcgaccctgccagcaggtactttcactgcgaccttctacgttcagcagtatcaaaactaatttaatttaaactttataaatgccctcaatatgagggcatttggataattttattattttaaaaatatctattttgaatagataggttttatgcttccatgcaaaaacttaaagagggattatgtatattttgaataaatgtatacgtataactgttatctttttctttttttgctaccttccaattgcttcttcggaaagtaaaaaaattgagcaaccattattaacacaaaaatattatggcctaagattgggcactacacgtgttatttataaagaagatgctccatcaacaagtttttggattatgaatgaaaaagaatatccaatccttgttcaaactcaagtatataatgatgataaatcatcaaaagctccatttattgtaacaccacctattttgaaagttgaaagtaatgcgcgaacaagattgaaggtaataccaacaagtaatctattcaataaaaatgaggagtctttgtattggttgtgtgtaaaaggagtcccaccactaaatgataatgaaagcaataataaaaacaacataactacgaatcttaatgtgaatgtggttacgaatagttgtattaaattaatttataggcctaaaactatagacttaacgacaatggagattgcagataaattaaagttagagagaaaaggaaatagtatagttataaagaatccaacatcatcatatgtgaatattgcaaatattaaatctggtaatttaagttttaatattccaaatggatatattgagccatttggatatgctcaattacctggtggagtacatagtaaaataactttgactattttggatgataacggcgctgaaattataagagattattattttaaggtgtaaacaaatgaagaaaaccacaattactctatttgttttaaccagtgtatttcactctggaaatgttttctccagacaatataatttcgactatggaagtttgagtcttcctcccggtgagaatgcatcttttctaagtgttgaaacgcttcctggtaattatgttgttgatgtatatttgaataatcagttaaaagaaactactgagttgtatttcaaatcaatgactcagactctagaaccatgcttaacaaaagaaaaacttataaagtatgggatcgccatccaggagcttcatgggttgcagtttgataatgaacaatgcgttctcttagagcattctcctcttaaatatacttataacgcggctaaccaaagtttgcttttaaatgcaccatctaaaattctatctccaatagacagtgaaattgctgatgaaaatatctgggatgatggcattaacgcttttcttttaaattacagagctaattatttgcattctaaggttggaggagaagattcatactttggtcaaattcaacttggttttaattttggtccctggcggctaaggaatctatcatcttggcaaaacttgtcaagcgaaaaaaaatttgaatcagcatatatttatgctgagcgaggtttaaaaaaaataaagagcaaactaacagttggggacaaatataccagtgcagatttattcgatagcgtaccatttagaggcttttctttaaataaagatgaaagtatgatacctttctcacagagaacatattatccaacaatacgtggtattgcgaaaaccaatgcgactgtagaagtaagacaaaatggatacttgatatattctacttcagtcccccccgggcaattcgagataggtagagaacaaattgctgatcttggtgttggtgttggtgttggtgttggtgttggtgttggtgttggtgttggtgttggtgttggtgttggtgttggtgttggtgttggtgttggtgttggtgttggtgttggtgttggtgttggggttcttgatgttagcatttatgaaaaaaatgggcaggtccaaaactatacagtgccatattcaactcctgtattatctttgcctgatggatattctaaatatagtgtaactattggtagatacagggaggttaacaatgattatatcgatcctgttttttttgaagggacttatatatatggtctgccttatgggtttactttatttggtggagtgcaatgggcaaatatttataattcatacgccataggcgcaagtaaagatattggtgagtatggtgctctgtcttttgactggaaaacatctgtttcgaagactgatacatccaatgaaaatggtcatgcatatgggattagatacaataaaaatatcgctcagacaaacaccgaagtatctttggctagtcattactattattcgaaaaattatagaactttttctgaagcaattcatagtagcgagcatgatgaattttacgataaaaataagaaatcaacaacctctatgttattaagtcaggcattaggatctctgggttctgttaacttaagctacaattatgataaatattggaaacatgaaggtaaaaaatcaataattgctagttatgggaagaatttaaatggtgtttcgttatcgctttcatatacgaaaagtacatcaaagattagtgaagaaaatgaagatttattcagttttctactcagtgtacctttgcaaaaacttacaaatcatgaaatgtatgctacatatcaaaactcatcctcttcaaagcatgatatgaatcatgatttaggtattactggtgtggcatttgatagccaattgacatggcaagcaagagggcaaatagaagataaatcgaaaaatcaaaaggctacatttttaaatgcttcttggcgaggtacttatggggagatcggagcaaactatagtcataatgaaataaatcgtgatattgggatgaatgtttctggtggggtgattgctcattcatcaggaattacgtttggtcagagtatatcggatactgctgcactggtcgaggctaaaggtgtaagtggggcaaaagttctgggcctaccaggtgttagaaccgattttagaggctatacaatatccagttatcttactccatatatgaataacttcatatctatagatccaacaacgttaccaataaatacggatattaggcaaactgatattcaagtagttcctaccgaaggtgctattgtaaaagctgtatataaaacaagcgtgggtactaatgcattaattagaattacaagaacaaatggaaagccactagctcttagcacagttctttcacttaagaataatgatggagtaatccaatcaacatctattgttggcgaagatggtcaggcatatgtatctggattgtcaggagtgcaaaaattaatcgcttcgtgggggaataagccctccgatacttgtacagttttttactctcttcccgataaaaacaaaggtcagattagctttttaaatggagtgtgcaaatgaatcagtataattcgtcaatacctaagttcattgtctctgtttttctgattgttactggttttttcagctcaactattaaagcacaagaacttaaattaatgattaaaataaatgaggctgttttttatgaccgtattacaagtaataaaataataggtacggggcatctatttaacagagagggaaaaaaatcctcattagttcaagtttagaaaaaattaaaaataccccaggggcatatattattagaggtcagaataactcagcccataagcttaggataagaataggtggagaagactggcaaccagataattcaggtattggtatggtatctcattctgattttactaatgaatttaatatttattattttgggaatggaaacattcccgttgatacctatttaataagcatatatgcgacagaaattgaattataataaagggtgcgcaaattggcgcacctataactcttaattataaagcataaatacagctttttctcctgtatttctatgcttatattttagatggaattgttttggggttaaaccataatagtcagaaaataacttaatgaaatatgatacgcttgacattcctacggcatatgatactttattaatatgtgtgtcgctatcaagtaccaaacgcgctgctttttgcatcctggcatctagaaggattctgtaaaaattagtattttcattctcaagtttttttctgatagtcacttctgataaatttagtttttcggataatgtttttaatctccattttgttgaaatgtcattatctattgtttttctaacaatatcagaaaaactacgtgagactgaaatgcacagagatgtgtatagctgctcgatattattcacttttgaaaataaacaggcaatttcataaatatcgttgttgttattttttctcttttttaaatattcaaataaaattccattaattccactgtcggttataataaaaaccttatcgctaaatgttctgtagcgtattggtgataaactttctgagcaattagaagcctcaaataagcataaaactctacttaataattcatctggtaaagtaataatatcaaatgattcaatatcatccatatattcaatttccacaacagcttctatattttttctattaaggctatgttgcctctagttatttttatttcctctggctttgacttgttcttaatggtaataatacagtttttcgaatgtaaaatagcataacgatatagttttatttttatggcgttttttttcagcatggaattgcacctaatttttacgcttcactgcagaagccgattttatattattgtaggtattgttttatgatataaaaataactttattagatatgattagccgaagatgatgttttaaaatatctaaatacagtgtaagccatgtgtggttgttataagtgctttataggagttgttgtttcgttatgctcaattaattgtgttcatctatatccaacggagagccatgtgatatttcttttaatgccggtactgtacagtccgggcaggcttgattggacctataaaaatagatatgactatctcctaagattttaaatactccgtataaatgttgaatggggatactgaaatgcctttgatgtgacgtcttaaaggtagggctttatacataaccaatactcgagtgactctgatgaaagtgaatacgcataaatgaaccatcaaaatattcatatatttttacttttcgtcttggtttgaccatatcgtaatgaggttgctatagaatggattagtattattttgtggtagtggtaaatacatttattttaaccttgaagagtggggccgtttatgggtgaatccatcattacaaacatcatctccatcatccgggagcgtcagagtacggacaacgcgcctgttaaaatccgcgatattgctgatgctgccggactcagtatctaccaggtccgctcatatcttgagcaactccgtgctgtcggggtgcttgagaaagtaaatgccggaaagggagcgcccggattatggcgtctgctttgaccgctttcccggaagacggggacatcagccggatatggtacgatcggctttgtatcgaatttaacagcgacggcggactgagtccggctgaactgcgggttatccgactgctgctgcagggctataactgcgggcagattgctgccctctgttttcgcagcgtcaaaaccatttcagcccagaaaggcctggctttcaggcgcctcggcgtcaggaatgatgccaccctgttgccaaccctgatgcttctggggatggtgacactgtatacagacctgaaccggtgtcattcactggaggagagcggcccggaatgtgggtcggaagctggataagtatcactgaaagttattttatcatgttcatgaaattcgtttattacgcctgtctggccgtcgtcatattaatggcaatggtcttttgtgtgtcagtgctttttattctggaaaactcatgaccggaatattccggctgccggcttaatgaccgtgccggatgaattaagatttactgctgctgtcaggcggtaccgttaagcggcctttcattctgtatatctgttatccatggagtgtttccgtgacgatgaattatgcccgggagctgtttttcctgaggggaatattattttcttttttttttacctggccgcgcccgtcctgtgattgcgcaggagtgggagttcataactcccttggtggctgatgcccccgccgaggtggaactatttttcttttactgtccgccctgctatgcgttctcacagacgatgggcgtggcccgggccatccggcacgtactgccgcacggtgaccggatgatcaagtaccatgtcagcctgctgggccccctcggccatgagctgacacaggcctgggcgctggccatgatgatgaaggaaactgacgtggtcgagaaggccttcttcacggccgacatggtggagaaacgcctgcattccccggacgatgtccgtcgggtgtttatgtctgctaccggtatcagtcgcggggagtatgacagaagtataaaaagtcccgccgtgaatgacatggtggcattacaggaacggttgtttaaggaatatggcgtgagggggacgccttccgtgtatgtccgtggccgttaccatatcaacaatgccgccttcggtgcattctccgtcgaagatttcaggagccgttatgccgcggtggtccggaaactgctggccggtaaccctgatgccgactgatgataaaggcaccatacaggccggagatatccccccgctccgcgcgctgattctcctgctgctgaccagcgtctttatctccggctttctgaccggcgtcttggccatgctctggcttatctgccgtggggcatgatgtgaagtccggtctcccctgtaacagaaaacataactttcaccaccacgatgttcagatatttatgtaaccagaaagctgcactgctgaccgccattctcctgatggcggccggcgtgctcaccctgtgtttcccggagtcctggtacccgcaggaaacagaatggcagctcacggcagaaaaagaaattaccgggatacacggcggcctctccggcctgacatggaacccggacagcagaacgctgtttgccgtgaccgaccacctctcctcggtggtggagctggacacggaagggaacgtgctgcgggtgataccgtcagacggcgaccacgattttgaggccatcgaatacctcggcgggaaccgctatgccctgtcccgggagcgggagcggacgctcaccacccactgcattgacagcagcacgaccgtcctcccgccggcaacatacagcctgacgctggatgtgaacaggcacagcgacaatgccggttttgaaggccttgcctggggacggggagagcatgccctgatggtggcgcaggagaaaaaaccgctgcggctttacgtgacggaccggagccctgatgcgctgtcggtgagtgactcgctgacacaccgggcgtccctgccatggttcctgaaggatatctccggtctgcattatgaccggaacaacgggctcctgtatgtactttcccatgaatctgccgtggtcgtggtgtcggatctggacggcgggaggaaggtgatgtcgctgcgccggggacactgtggcctgcgaagggatatcccgcaggcggaggggatagcctcagatgaccgggacacgctgtggatagtcagtgaaccgaatctgttttaccgcttcacccgcacggcttcgtcctgaggatgaggcggcgcggaaggtgaagtaaaattcgccgcgtgaagccgaccggtgttggtgccggtgtcagcggtggattctgacagtggaaagatgatgaaaaacataacattcagcgcatcttttttcagggaattattctggtttgtggtgatggtgggaagctggttgatgaccttcccctgaccttccccctgtaaacagtgccagtctaaactgaagtttccggtctttcttccatctcacagagaggcgcattgccatgaaaaagacccgttataccgaagaacagactgcatttgccctgaaacaggctgaaaccggcacccgcgtcggggaagtctgcagaaagatgggaatttctgaggccacattttacaactggaagaaaaaatttgccgggccgggcgtgacggaacagcggcgtctgcggcaactggaggatgagaatcagcggctgaagaagctggtcgctgagctgagtctcgacaaggagatgctgcaggaggtactgaagcaaaagttctgaggccggctcagaagcgccaggcggttacatttttgcgggaggcttactgtatcagcgcccggttctgacgcatgtcgatcagtgccggagtatggattttgtgtcagataatctgtttaacgggcggcgttttcgggcgctggctgtagtggataattttagtcgggaatgcctggcgatccatgccggaaaatcgttaaaaggcgaggatgtggtcagaataatggaggcactgcgggtgccggataagcggctgccggtacgaatccagacggataacggcagcgagtttatctcaaaaagtctggataaatgggcgtatgaacacggcgtcacaatggacttctcgcgccccggaaagccgacagataacccgtttattgaaccatttaacggcagtctgcgggatgaatgcctgaacattcactggttcctgtcactggaagatgcgcaggaaaaacccgacaactggcgcagggaatacaatcatgagagaacgcattcatcattaaatgacatgactccggctgaatttatccgaagtctccggaaagacgaagctctctgatttagcactgtactgaatttgtgccagggtcattatcgacatgattaccggcaagcgcaccaccgcctgatgttagccgctcccgatgtttaatcgggagcggtttcgcattaagggactatcacctgcaccagcacatcggttgcccaactttcctcgctgttgaccacctgaccttcaacgcaggcttttgccatattcccgagctggaaagccacatcatcgttaaaatcaaaatcgcgatacgctcgcgcaaagacgatgcgccagtatcccatcccttggtcaaaacggatcttcagcgcctgaccattactgaaggtcaccatcagtttacgatggtgtggaatatcacgcggcgagccaacggtgttaaccacgacggctctgcccatagatgccgcaaaccactggtcggcaaaatcctgaaaatccgcttcactcatccagtcatggaacggcttgttgcctggccgctctttactcttaaacagcgtatcaatcgtcacttgcgcatcctgcgccaggatcgatttcagcggttttaacagcccgcctaataacgccagcgccaccgggttttgcagataacgatcgctatagtgaatgcgcgtcacctggttttccttcagcagcgtctgaatatcttcctgcgccccggttaacacgccccagaaacgctgaccaaattgagaaaccgggccattaagctgcttatggatctcaatatcgttgaccaggcctctgctacctgcggcatcggataatagctctgctttactaagcgttatcggctcaaacgcatggctgcgaataaccatctggctattcagatgccagttcgggccggggatggtggcctctgggctgcgagaaatcaacatcatcaggcgatcgttgaatgctacctgtgcgacaaccggcgtatccgtattcagctcagactggcaaagctgcataccaatggcggcaaactgcgcaatctcctgtaaaagctccggatcttcaatatgaccgggcacaaccagcgtaacctcaacctcatctttcagccgatagttctggatcgccgttcggaactggcgggcatacaaatcccactcgttaagcggcccattcatccacaacgtgagtttgcgcgccccgtcgttaatggcacgacggatagcatcctcaatgctgcctgggcaatactgcgcgtcggccagggagaatttttccgcctccggcaaaccgatatagtgactgaaatcctcccccagccaggcctgcgcggctttacgatccagctgatcgtgatcgtggcgggtctgcgaatcgagcagacattcgctacaggcggtatcacagtggcggcatcccagctgtttcaccatccctttgaggaccgcttcaatatgcaatggcgcactggaagcaaaccccgcaccgccgctgataatgtcgtaaagctgcaccgccaggaccgattgctcattatccagtctgaccggacgcaccgcatagcccagttctgtcgccgatacccccagcacgctggccagcgctcgacgtagtgtaaccgccagcgtcatggccacaatacggccttcatcagaattatcggggatatactccccgttttgcggacggcgcaaaatgagttcaaacacatcggtgcgcgccagcgcacccagcgtgacattcttattcagcgccgtggagccagggcagataatccgctgattctggctgtcgcgatcagatttaccggggcgcggaggataatgcgcttccatcgatttcggcgtatcggtggcattgagcattgactccgcccggccgcagctcaggcacagcgcataaccgtgtccaccttcgcccatgctctgctggaaaacatgaccatccgcgcctgacgccataaaacccatcagcgggtttggcagtggcacgcgttctgctttcacaaacacccaggcaggcaccaccgggatgaatttcattgtttcaatgttgttcgtaacgggagtatgggcatcggtgacaaaaccggcgggctgtaatacctgacgtcggttatccagcgtgatccgctccccgcacgcgctattggtacagaataaatcccccgagccaccaataccttcctcatagcctaaagtaccgcatttatggcaacgccaggcgctgtccagacgctgggcttcgttagtatcggcgttaaggttatgccagtgcagcgaaacaccggccgagcggaatacccgaccatcaaggataatctccgcgcccggcgcatactcacggatcgcaacggaaaggttgcgcgaaggcagccctttataacgcgaaacgttatcctcccggtcattcttatcacggcttttgtgcgttttctcgcggatataatcttccatggtgaagttatcaaaagtgacaacatccgttgggaagccatatccgggtaggaaagttcgggccgccagatcgcgtaacaggtattcaccacaatgccgttttttctccagttccagtcgcctgcggtacggcgtattgggctgcgattcactttcctgtttcacgagatcgcggaagatccccagccagcgtgtctgtaagacggcaatagcctcctgcgttttatcccgcagtttttctgccgtaacgccgtgcaatgccgtccctttaaccagacgctccagcgcgttatcaatgctcagcgtcggacgttcgagccaggctttaaaacgattgcataccgactggtcgagctcttcgccaaagaaccactggctattaaggctggtacgctctttttcggtttcaccgaccacatggcataagtattctgacagtaacagggaattgacgtgacgctgcaccagacgctctgagttcattgccaccattggagccgggatcaccgtctcaaacggccagaggggattagcaaaaacctgctgatcgtgcgggttccctttgcacaaggtgtacgaaatagcgcgtgactctttactacgcccggcacgcccggctcgctgtaaatagttggccggatgcggaggaacgttgttcatcaccactgcagaaataccgccaatatccacacccatttccatcgtggttgagcagttaaggacgttaagctgcccgtttttaaacattctttcgtagctttgcaggcgctccgacgattgctgtgccgagtgttctgcggtgcggtagtaaaatccaccttctaccacgcgatcgttaatgtccgtccagaggttttgcgagcgtaatggtagcacttgcggatcctggcttacccagtcacgcacttttgttaacccgtcgacataatcatcctgagagcgatcgtgttcccagatcgctggcagcgtgacttcctgagccaaaaacgcgtcgtactgtgcactcgtcagtcgctcgaactggatatgcatgggcaaatagggggtcagacctttgaaggttgtcgccagtaatttattggtcactggacaaatgcgtgctttttgcaccagagagaatgtcagatgctctttcggtaaataaaaacggtttccatcaggcttcaataccgccagagatcctgttagctggagccaggcttctttcagccaggcgttaacaatatcaatagttaccgtatttacggtgttaaatttggcccctaaaatcaacagcttgaccaggcgctgagtcacattaccgtggcgaatttgcggccagcgtttaacctggttgtcatctggctctttcgaatctgggttgcggacaaatttggaagagaaacggctaccgatccagtttcttagatcgtcatccagttggatgtagttgctttctctgacatagaaatccagcgtcaccttcagaaaatcgcgccagtcatcaagggttaagcctttagcctgccagtgagtaggaacactgtgagcctgccttctccagcccctgatagccaacctgaaccagcccctgggtttccaggctgttggttcgtttcgggcgtcgcataaactcacggaaaagcagcatttcggcgagtttcaaagggccgccattttcggtgaaaatttcaggcttcagataatggttatattgtaaaattggtccctgtatatcggctttctctttcagatcattgaccatttccgtccaggttcggcaaactaaaatggttgcagcctttccctccgtcgccgtctggattgcctgttcaaggcgttcggcctgagcttcagaaagttttgcttcctcgggcattccccactcgcgatactcccgggcttcttcacggtattgtgtcacccttgcaaccagtttcatcacgtcagcctggtcattcggagcactcgttggctgttttcgttggtgccagccaagaatttctactacgctaccacgtaatcggctgcgctctgcttcctgctgcatacgtactgccattcgcgccgtcccctgacgactgtcggtaaaggtaatcaggcgacgacctcgaccaggcaaagagagcgggccgacaccatctttaccttcatcactagtgaagtcctgacaatactccagcaccgtaggcacaatattggtgacataaaaaggcccgcccagtaacgcccttcggaagggctgtttaccctttccgcctttatagccacaattgctggcactacagatttgttcgatatcattaattgccagcggaatactgtccgggttcaccacgccgatactgcgggtctgacgatcgagccgctgcataatatagccagcttccgtattacattccgcagcaataatttgtggcgactggaatacaaaatccttctgaatcttttctccggatgtttcaaaatcgtcagaaatttcatcctgtagggagaattcatctccacctttattatcccactgtacgagtttgccttttttatcccgtgcaagaagatgcggttcattacactcattgcagaatgccagttcaaaaacgggactgccgcactcgcagttttgccgctgatttacatacacattgccaaaagaccagtttttttccagcgcggtattttttttagctgcacagttcttatccacacatgtccagatgccctgggtgtttcgctggaaaatatgtgctctgactttcagaaatgcaggatcctttgcattagggagtgtgccagagcaaagatcgatccagcgtaaaacatcctgctgcgtgtactgatgtttggtcagctcgttcaaacgctgggtcagcgtatcaagtttcattggtcggggttggctaaccagcatttcgcgtaaacagcgcgcttccggagagtgggtcaacgcactataacgctccggactgatctcttcactctccgaatcagggatatgctcaatctcatccagtgacagagaatattgtttgcagggttcgagctcaggaataacgcggcttccgcccagaacatcaatacgttcctgtggcactcctgacagctcagacaagaattttttcagctgcttttcagcatcacttccggcaatggtggccgacgtcgccacaaagcgaacatcatcaggcgtgacgccaaatgccgtcatgacgcgacggagctgtagagccaactcagcggcctgagaaccaacgtaggtatgggcttcatccagaactatccagcgtaatgatttttcagcttttgatttctgaataatcggtgcatcaacctgacgaaccatcatgtattccagcatggtaccgttggtcactaaaatgggggcgggttcttcacgcatcttctctcgtgacaaaacctcattaggcctgtttgcctgctcacttttgaccaaagcgtgcaattcttctgtgttaccgttatacagacagtaccgaattccggaaccaaaactacgggtccacgcatctaaacgctcgcgctgggaattaatcagggcattcagtgggtaaagaaaaagtgctctcacacctatcaacggttttttgttcttgacctgaagctcacgatagaggtcttccagtaccgggaccataaagcattccgttttgccagagcctgtcccgctggtcaccacgactgagtgttttttctcaagtaatgattgccagctggctaactgatgcgtgaaaggtttccagtcagagccaaaacgataacgaccattttcctcactatccagcgagtccaccacctccttgcttagcaacgtttgttttgttgcaaggtctttcattgtgctgttggactctttccagccaaatgtctgttcaaatacgggggaggcaagaaacgatccttctttcccgcaatcggccgccatttgttgcgtgagatgctcgcgaagattcgggttggtcacccccataatactcagcgtcgcctccgtagaacgcgacagtgattgttcaatcagcgaagaaaaatagcgtgtagtcattcttattcctttttatttttcagtaacattacgcaatagacagtattggaaaatggcgttaaaccatcgtgagtcaaaatctctaacctgtctcaagaaaaatacggcgccgggcttattctcaaaaacactttcaaatgttgttttaccgctggcaacagcagcagcaaatacggggagcaaggtgacggaatagcggtagctggcatcaggggaaatatcgataacaggattttgttgcgacatataccaacgtaaaaggcctgggccaccaaattctggccagcgagattcaccatgttcgcgtagaagttcctgataccactcaaggataatacctttcatcgtcaactcaggaaaaaccggtggtaatttcccttgactcaaccataattgcacctcactggcataagtcgggaatgttgtgcccagctgttgatacattctgtacagcaaccttatctgcatttcctccggtgcacctttatgagtcaaaaaagcacgaaaacgtgtggcggaacgtttaacttctgtaatggataaaaactcccagaaaacgggaaactcactttcaatacggctgagataatcaatggacatttcaaatttgaacagcgacatcgccaacgcttgtggatgctgaacaagtgcccgccatacttcaaaggtagccaaaggtaaatacccgaactgatcgtataaattgcgtaagaactgccagcccgagtgtgccgggtcgctcgccatttgttccagaactaacataatggtgttgacatctgaacgaggattaaaaagctgcgttgctttttgtaaagactgtattgctgtcgcgtcgctttgaattaccggctcacctgcaataaagcaaggtcgaaatgaggcttcttcacctggtttcggcagcaccagccatgggccattcttttgtattatcgaacttagttcaaattcaccaactggtacaccttcgctcattcttgacgtcagcagtacaacttttctctccggttcgctgagtaacataatgacgggcgaagggatctggcctgtacgattacttattgagtttgcgagaagaatctgcctgccacgatcatagtccagactatatttataacgtcggatctgccaggtaaaagaactaccacctccttttatgcgcatatcaactgtttgatcaattccttcctccagggagagtaaattatcaatatgttcccttaagctatataaagtaagctctaccggacattctcccgcactgtagtgccactcataccaggcctgcattccactacgcgaacgtaaacgtagttcaagctggtatcgcgtaggctcaccattttttccgaaaagatatgctctggcacccagaagatcgttaatcgttaaatttttcgggagaggtttctcatctttatcgaacgcaagacagcctcgtgcaggaaatggtaaccaaataacaatcgggtttgcagtgaggtttggcgttatttgtaatgaaattgatgcaggaggaatgccctccgccttcatcattatttctgtactatcgggcaaccgcttccgtccaacttcaagtgttttttccttcaagctatacaaacaagggtgctgagtagtaataatgacagaaccttcgttcgcctgttgtccattttttatttccagactaaaatcattggggagaatgccaattttcttacgcagtaacgtttcatcattttcgttacgcaccgaaataaactgtgctcccattttttcttgtacatcacaattttctataaatgttccgttgaaaaaacgcttgtaatggcgcgttgatagattctcagaatgttgagtaattccaggaacaccgaggaagagttcatccggataacttgtccaatttaatcgcttcccctggaaagagaatccagtatggataatctgatctcttcctatctttatccggtacgtttcatcgcctttaatgatgatatcctggcgacctttgatggtcagagcatggcatcccaaagccgaaaagccagagtcacaatcctcatgttctgaagccagacagccatcctttggcagcacaataagtacatggctgccacgtacgctgcaagaggcttgtccctgtaacagccattcatttttatcagaaacaaaaaccaatggaacatcgccaaccgcaacttcactgccttctaaaagattggagccgaaaaacatacccccagctctcgccacaataaacaaactgaccgtgggatttcttcggtaaaatttaatctcgcgcttacgaacttttatttttgcctgggagttacttagcgttgcatatgcaggtcccagacttgcgatttcgttaccatcttcatagatagcaagctcgaagcgcgttgttgaaggctcaatatcaattgaaaaactcagttcttcaggcagagaaatgagtgcctggagggcttcaggatgattttctgaccataaaaactgacagagagtggttttattcttttgaaggcggggttttgattcagtagaagctgttcgtaaaagtccattaaggaaactggtacccgtatcatcatcgagagggacagggaaactgtcacgccacttaggatgaacacgttcaagttcttttacgggttcggtatgattacttaaatcataaatttgaacaagagatactaactgttcagccatccgactaataagctcaactgaagtatcctctttgaaaacgactggcagggatgatttttctaccgctgcatggactaacgcgaacgtggaaatgttagaagatttagcctgatcgtattgatttagaatgagagaaaacatcgactgaaaacggctattagattcctttagcaacctgaaaggtagaccgccttcactgaataaggagcctaagaaattccgcctttctgtgtcataaaaccgcactggacgcccccagtaaccatccaggcctttagggataattttccccattttcgaggaagatgctgagatacctatcgtcttgtaaattggctcccatgcccatccatactctctttcataatctcttcgataccactctgagcagaacaatgtgaaacaggctgcgtaccctttatcacttttataaccatcgggtacccctatagctcgcagcagccgtttcaattcatcatattcttcactcgttgcgtggtattcatataacggacgatggtctggttgcttcaatcctctgcgggtgaggaatttagctagccatggggtacactttagaatggatgcgtattcggactgactcaaagcaagctccttgcattagaacagtgaatggctgaaagttattataactttttgttattttgaaaaaacagataacaataattgaattatgaatttaattaaatttgaaattgatattagtttgattttaatcaataagttaagtttattatacggaggggctactcgccatttgttttaatctgtaaggagatgatttgtagctacaaatcttttcaaccccatatcatcccattgaacctccggccggaaccgtctttacgatggttccggccttctttttacctgcctgcctacaaaggagtgatatggagctgaataacgaataccaaaactacgaagacgaggacgacgaaagcgctgacgacctccctccatcccaccacccgcgctctttccagtccatcatcggttggctctacgacaaagcagtcagtggtatcgcaggcatcgaatccgctgaaatgcttgccgcccgttatcttgaggacgcgaaagggtgatgcacagctcgccgcccgcaccatgatccactgggagagcatcatcgcaactatgtgctcatgaattcttcaatgtaatgacctctgacaaaaccctaaagcaagcgatatcaaatattactatttggcgcaaaggcgaacagcgagcgccgcataagccgttattgctgttatatgttctctcgcactatcggcagggtcacgatcgtctgtttgattatggttctgaaattcatgagcaattgctggatttgctggagcgctatgggccacagcgccgtgaacagcgcccggatatgccgttctggcgtctgaagggcgatggtttctgggaattgcaaaacgcggaattctgctcaaccagcggtagccgccagccacctaaacgtgaactcattgaatataatgttgctggtgggtttgatgccgtcaatttcgcgctggtaacaaaaaaacgtaagctaatcgacacgctggcgcagcagatccttgaggcgcattttccgaccagtattcaggaagacatcgctgacgagatgggttttgatattcgcacctctttccgtcaacgcgatccgaagtttcgccaggcggtgctacgagcttacaattatcaatgtgcggtctgcggcttcaatatgcgccacgacaacgcccctatagcccttgaagcagcccatatcagatggaagcagcatcatggtccttgtgaagtacctaatggcctggcgttgtgcgcaatccatcataaagcgttcgatcgtggttcgattggcctggatgaaaatatgcgcgtagtggtttccgacgcggtgaatggtggcggagtggtacagcggttgttctgggattttgcggggaaagagatcgcgttgcccccggttaaagaaaattatccgggtgagcggtttgtggaatggcataggaaagaggtgttcagaggagagcattgatctgggggagtattttgagtgtggtatacgttatctgttaaaaatagctccacatcaaaagcatcgaagtaatcggccacggttctcgcactatggtctgtagcgcgctggtggagtcacacctgtagtcaggcgacgcgtagagcgccagatgagccatcatgagcgcaagcggaatttatgaggcgcggcatcttaaagagcacagggagattgtaagtagcccgatattgctggcttttgcttatcttgctgacgggattcgtcgtatgaagcatgagaattacctcatgttttatataaggattcaacaccatatcaaaaccggtagctctcaacctttcaaggctatgtgtcagatcaagtggcaactaataaacataaatttaaaaacttatatatctggccagatagacttttttataacagctttataaattaaacaaatctgccatagagacagatttgtttaatttataattagaggtttgcaacgttatgatatactttttgcacatcatcatcatcttcaagggcatcaacaagtccttcaaagatttctaaatcttctggtgaaagttcaacgtctgattgagcaatcatttctaattctgttgttgaaaattcagtaattccagcggcttttagcgctgcaattcctttgtgcaggtctgtagcttcagtataaataacgatgtttccttcttcttcggttacatcacgaacatcaacttcagcatcaagcaaaatttcaaaaatatggtcagggtctgttcctttaaatacaatcactccagtattgtcaaacatatagctgacagcacctgcagctccgatattcccgccttttttattaaaaattgtgcggatattagcaatcgtacggttaacattagacgtcaacgtttcagcgataaccattgaaccattgggtccaaagccttcataacgcccttgcacgaacgtttcatctccgccacctttggctttatcaatggctttatcaataacatgttttggaacctgtgcttgtttcgcacgttcaataacgaattttaaagctgagtttgattccgggtctggttcaccttgtttagccgcagcatagatttctacaccaaattttgcatatactttagacgttgcaccgtctttagccgtttttttagcaacaatatttgcccatttacgtcccactggaaacatctcctcaaagaattatttacattaatggcaggttaataacctgcatatttttctaccgtattatatcataatatataaattctcgtctatgagaaataaatacatccagcttttacgaggggggtactttgattttaacaatggctaatatggtgggtaagtcattttttaattttcttctggttctttttttattcttaataattgaatcgcaacaataacgtcttattgatggtggtttcgctcatcaggtgaggtggaacgcttgcacgtcttgcgacatattgtggcagaaacttaatggcgaaattaagacgatatattcccgccttgagccgtgttaatttgttgaatacttttaaatggaggtatacctcttgtagggtatacctcctgcttcacgttatcgcgcgattaacgcaaatacgccccagccaaagtattctcgcgtccaggtgacgtgacgtttgggggctgccgtcagttctgttcgaacctcttgcgcaaactcatcgtcagggttttcctccagccagcggcgcatggtcatccacttagcggcttcatatctgtcccagccttgcgggtccgccagcaccatttccactacgtcatagccgagttggtcgaaaaaggcgaccagctcgggcagggggcgaaaatcggcgacggatgagacgccacaggcgtgggcgatctcttccgttgcggggatctgacgccagtacggtttaccgatgagaatgatcccgccaggtttgaggcttttggccagcagatctattgtccccgcgacaccgcccgcaatccaggtagcgcctacgcaggccgccacgtcatatttttcctcgtcgatataaccggccgcgtcgttatgaataaaatgtacgtattcactgacgccgagctcttctgcacgttgttttgcctgtgtggtgaagagcgggcttatgtcaatgccagtacctgtaacaccgtaatcgcgagcccaggtgcagagcatctcacccgaaccgctaccgagatcgagaatccgcatgcctggtttcatgcgtaacgcatggcccagcgtggcgtacttttccgctgtaaacggattatggatacggtgttcgctttcgctaatggtaaaaatacgtgggatatccattgggttattccttttactgagggcaataccctcagaagtggatgctttttcagccagcagcgcaaacagcttgcctgcaaaagtctcgccgaccggccaggtgtgactgtccgggcgctgcaacacagtgaagccagcatcaccaagcaggctgatatattcatcatcgcgccaggccttcatttgactgccgaaacgggtggtacagccgttttccgctatcgcccagaactgcgttgagctggtttgggcctcttcatcccaggcattttccgttaacagcagatgaggcacggcaagaaacaggccgtgcggacaacgctgccagcctggctgcgccatgccctggcgtttaacttcatcgaaggtatgcacttcaacaagcagtttgccgtccggtttcaaccactgcgcgcaatgactgatgaggctttgcgcatcagcagcgctaaagacattcagttccccaaacgtcatcataatgaaatcaaagggttccgtggggtggtatgtacgaatatcctgctgaatgtagtcaatattcaggtttgcggcttgcgcctgctggcgagcccatgtgatggatgccggagagaaatctacgcctgtgcagtgaaacccacgctctgctaacaggcgggtataaaaaccggggccacagccgagatccagaatgcgggcgcctgcgggtaactgacgggtaatccatgttacctgttgctcaatcacggttagccggcggctggcccagtcgtgatcctgtgacagatgattttccagcatgcgttggctgaaggctggctcgtcccaggggattttgccttcatcgggtaatagccgaatgcgatgcgttgcaaaaataacggcgctgatatccatcatcatctccttagcgattgtcaggctgggcgcgaacgttgttcagcccggttgtattaatgcggtagggctgaccgttaacggatttgatcagctttttggttttgagttttttgaatacagcgagcgtgcaatcggcgagcaacaacccttcgcggctatagcactcaacggcggtgacgcggcctgacgcatcgcggatgtgcgtaatgcgtccgcctttggcgagaacgtgtaaggtacgttgttcctgacgggataaattcatactgaagaacctgtttaatcatcataggcaaaacgtgcaaacacactgcggtgtccgcattcgatttcggcgcattgataatcagtccggcctgaaaaggtcgggtaactgattatcagatgatgacattctccagcatcaaagcctcgggttgagttgaaaggtatttacgtagtgaatgataacacctgatttctgtaagtgaataaccgggagtgaaaagtgtgatctcaaagggaggctcatgacgtttagcgtatcagatgaatagctcccgcaattaccataatgaatattgattaaactcatatacccgataatggccgctttgatagtctcgacgtatcttttggccgttgacagggttgtagcgttggaaatctttttttaacccgctgaaaaatatcacttaaatatttttcatacacaaacatttatggtccgctgagttcggatccggttttgtatgggttaaaaaaggtacgttatgaaagtcatatggactgtcactcctgtggggtatcagcgcatagcgaaacgttgcccttcatgcagcgtaaaacgggacttcacgccttctggggcatttcgggttaattcgcaaaagaaggtactcgatgtctggagtatctataaatgcacacactgcgattacacctggaatatctccctgttctcgcgcctgccagtcagcaaaattaaccgcaatctttattgccggctgatggcgaatgatgctgccacggtgcaatattttgcttatgacaacgcgatcctgaagcgaaacaatgctgaattatcggggcagcctgattttcacattcaggaacggtggctggtcagtatcgcctcccacaagcaggtcagtgttagcgtcaggatttcccgttcttttcaggtcagcctgctgtcgattttgaagaagcaactcctgctaagcgcagccgaaatcaagagacggattgaaacagggcaaataagtggcgtcacgatgaaaatgcttaaatcgcgaaaactgaagaatgcgaaatatgatttgcagctctctgttgaaacactgtatgaccggcgaaggattgttctgacccgtcgataaaaacaataagctcaccttacgtttaagtgtgctggtatggcaacgacgcaacagaatgaaagaaggactaagggacaggtgagctttagttgaataacgcttgtctgtggcattcagtgaagactgaatcgccacggataatccagacgttttcgcaccagtgatgatcagcagaatgacaaagggcgatgggttacaattatctttatctgtagagtaaataaatattcacgcaacaccattaaaaaataagaagaaatggctcactgttgagctgatattaatacctgaaccactgaattagagtaatgtggcgctattcatagcgtaattttttctgttgcggttacagggggaggaatgcacacctttagaccatacttactaaggcatagcgatctgttatatgaagatattccgttagaaatacgcgagcaaataatcttattgattattaatacattagggaattgctcctctttttatgatatgacattatactgctatcataatagtcattctgacgaagtttatcgaagaatatgtaaaacgttgcgcaaagagtatggcttattcaccttatatgcgcattcaacgtcatatctggatgaaatgagtaatctgttattaaaaacagatgataaaagaaagcatattgataccattgagcttgcttttaactatatagatacctaccttcggacctacgaagttacgcttgggttagaaccagataaggcgattagtgaattaaataatatatttcatgagcatagtttaaaatatcgatatgaaaatggtagaattgtaaggttgcgcagaataaaacggcttaaaaacatatgttattatttgtactctcctggagagtatggctttgtcgaatatgatcttatggaagcgtataatcgcctgatgcttaatgattttgcctgtgtcgtaagggaatgtcatgcagtcttcagaagcgttctcctcagaattcatgagagaaaaagtatcgtatatcatgaacaagatagtttaaatacactaatggctaatctgatggcgagaggcgttatatctgctgaatatgtacataaatttcattttttaattgacgtgctggagtcagaaatatttctgccgatggcgccagaaaagtcgcatcatcaccacgcaatgatgctccgtatctctgaagagttggcctgtagtatttattatcttactgagcggagtatattttttcttacccagcgggctgaagaggatggtgtcgcgccataatcataataatgatcgcgctgtcgctcagtcagattggatcatcgttatttaaatttgttcagacgtcggaattttttgttctgccgtctgtttttttagtgatgagctgttcagtgcaataataaggggtacagtacgatgactgatttttaaaccgcatatcatctgtgtcgcatttactcatgggtattgggtcagggagagagaagaatgagtactattttaaagccttttttatcggcggtaaccctgatgttaatcttaataaggcctggctttgcaacggaggatggagcgataaccatggttaaaacctacagcgcttatgactatttgcagacccgagcgcggttgatgcacgctgtcgccgatcacggtctggtgttatttggggaatttgaccatgccagagcggcacagaatgttaacctgaaaatgccgccgacaacggttctggtctttggcaatcctaaaggcggaacgcctctcatgctggcgcatcccgaactggcgctggatttaccgtttcgggtgctcattagccagcaagccgatgggcgaacgttagtcagttatcaccccgctgaaacgctgcaacgttatggtcttgatgccgcagacatacaggctttgaaaaaactggaacagctcgttgaaaaaagtctccactaaagctgaaaatcaggcttcaatcgggcgatgtgtttgcacaagtgatgtcgcgaataaatgcgctcacatcgtccattacctgatgagataaggcggcatcgaaggtggcgctatcagcatcacagaacccgtgccgcgcatcgtacattttacactgcacccgggggcgcttttccagcgtctgtcgcatggcgcggggatcaaacgccggctcataacgcgcgataataaccagtgccggacagagaggcgcaagatgaaggtactggcgtatacgggaaccgtaatagcaaatgacgccatcgcataacccactggctgcacttagccatgcgagcgttgcgccgacgctatatcctacgacgattaacgtctcgtactgcgctctgagatcgtggagtaacgtggtaacgacggcgggatcaaagccgacatttgctgaaaagtgacggtaagcctcctcctgctgttcatagcgaaagggggtatggtgaggaaacagcgcgggaatatagatgtcgaatccgcgcgtcatccattcatggcctgcgcgttggatatgagcgttaataccataaatttcatgcagaataatcgctgcccggcgatggcggctcgacaaactggaggcgttgcttcccccggatacgcttggggcgaaaaacactgtgtcttttatcataacgcgttcttgatacaaagagagcggctggattttcgccgatcacgctatgtcagaggcgttgttcctgtcaatgtacagacacattttatggcgtaatttttggttgataaattttatattggtaaaccaatatgttgttcatattcaggcatcagggctaaaggtggaacatcagtcgtgtattgtctactgcctttcctttcatctggcttcactaacgaaacggggcgcattattgttttgttggttgaccagtttcgcgtttttggtgtgctacgcgtgctatccctctttacaaatgctatagtctgataccgggaaatcgcatcggacgggcacgaccaatatgaaatcaaacacttctcagcaaagaccttaccaggaagtgggcgcaatgatacgggatctgattgtgcagacgccgtaccgccccggggagcgcttgccgccggaaagagagatcgctgagaggctcaatgtgacgcgtaccgtcgtgcgtgaagcgctgatcatgctggaaattaaaggtctggttgaagtccgccgcggcgccgggatctacgtgctcgacagcgcggataataacgagatggaaggcgctgacgtcaatcactgtaatgacgccgggccgtttgaactgttacaggcgcgtcagttgctggaaagtaatatcgctgaatttgccgctctgcaggccacccgcgaggacatcattaaaatgcgccaggcgttacaactggaagagcgagaactcgcctccagcgcgccgggcggctcagaaagcggcgatatgcagtttcatctggccattgccgaagcgacccataacagtatgttggtcgagctcttccgtcagtcctggcaatggcgtgaaaataatccgatgtggctccagcttcatagccatctgggcgatacgctttaccgtaaggagtggctgggcgatcataagcagatcctcgcggcgttaattaagaaagacgcccgcgcagcgaagctggcgatgtggcagcacctggaaaacgtgaagcagcgtctgctggagttttccaatgttgatgacatctactttgatggctatctgtttgagtcatggccgctggacaacgttgatgcctgattatacctggaatagcgtgggcagacccagtccacgttttacttcctgtagcgtcttttgagtgacctcatgcgcccgctcgctaccttttttcagtaattccattagcattcccttatctgcaataaaggttgcccgtcgttcgcgtattggcgcgatcagttcttgcaggcaggtctccagctcatttttacagacacgatcgcctaatccgccttgttgataatgtgctttcatcgccgcgactttggctttatccggatggaacgcatccagccacgtaaagacgacgttaccttctatttttcccggatcgctaatttttaaatgattgggatcggtgtacatcgcgctgaccgcacggtggatggtttcttcgctggcggaaagaagcagggtattgacgagcgatttcgacatcttggcgctgccgtcaatgcctggcagacggcccgtatcgctcaggagcgcctgacagggtcgcaataccggcgaggagaaaagactattcatcttatgaacgatctcattcgtttgctcaatcatgggcaattggtcgtcgccaaccggtaccatttcggccttaaaggcggtgatatctgccgcctggctaatgggatacgccatgaacccgaccggcagggaacgggtaaagcctttttgggcaatctcattttttaccgtaggattacgctccactcgggcgacggtaacaatattcatatacagcaccgttaattcagcgagggcgggtaatgcggattgcaggcagatcgtcgttagcgcgggatcgatgccgacggccagatagtcagctaacacttgcggaatattatcgcggattttttgcggattactgccgttatcggtgagtccctgcaggtcagcaatcaggacatactgttggtgatcctgctgtagcgcgacgcgctggcgcagtgaaccgacataatggccgaggtgcagcgagccggtggggcgatcgccagtcagaatgataggaagggtgttcattaaggactcctttatgcttactgtaaagccgaaagacgtcccgaaacgcagtagccgcctttcggcggctacttaaaaagggatagtgatccgtgccgccttcaggaaggcagccaccagcggagatgacgttgcgtagcgttggatcgtttcgtgttcatgtggtctaacgtatcacgactaaacgtaagggtaaagcggctggcgtgtcgtccgggcataaagtcatatcgcctgcacagagaacatgtcactgactttgaaacgcgattttataatttgctgcccaaaaatacgtggcgctgaaaggcgcatttttgatgcaagtcatttattactgtgataacactgcgcgcgataaaaacattaaatatatttacatagtaaatatgttctattggaatggttgttttcgatatgacaaaagtctaaaaaacccattgatgtgaaaaggaataagaattgtctacattccgattctgtggaattaagtaatttctcggataaaaataagaaatgatattgatatttcttttttgatatggttcttatagcggctatggttattcaggaaacgatgcttgaatgccaggcgtaatagatttcaggtcagtagcgctattgtaaaatggattgttgatggcagaaggtatttagcaagaatccagttatagcagattgtcggtatttaatctggtatacagagacaccaacgaaatggctggaaaatggaacgttctttcattgttggcgttccgtccttgtcagcctgctttgccgcatgataatcacggaggggggatggacgccatctatttaaaactggacggtattgaaggcgaaagccagatcaaaggttttgaaaaccaaataaaacttattgcttacaaccacaacccgacgaaacgggagtccggcgaagcgagagggacatatattggagggttgacgctgacaaagccagtcgatcttgctacgcttggcctctatgagcactattgtaacgggaaaacggtgaaagaaggcgtgctgacattatgccgtagtgataagggcgcaatgctgccatttattatttatacgctcaccaatgtgcgaatttcacgcatgagcaatcatggcgacgccgaaggcagcgccacggagaccgtggatttggtttatagccatattcgctgggatattcccgcattggcgtcgaaaagcaaaacacggcggccccttcaccgacaggcgctgtggcgatgaggacaaaacaagcttgcggactcgcagtgggcgatgctgtatagcgaaatggcatttagcggcttgcgaaggctgatgagcgctcatgtaaccaatcgattgcctgaaaaggcgataacgcatggcccttacacccgttatgatttttacgcatagccgctaataaaacggcattttttatatacacatcaagttgatagtgtgtttctgaccttgacgtaaataagcgggaaaagcgatgaaacacaccattgggatactgggggggatgggacctgcggcaacggcggatatgttggaaaaatttgttgaattgcgacatgtcagttgtgatcaacaacacatcccgctcattgtcagctctatccctgatattcccgatcgtacagcatgtctgttatccggcgggccttcgccataccgttatctggagcgttatctgcatatgctggaagacgccggggcggagtgtatcgttatcccatgcaacactgcgcattattggtttgatgatttacagaacgtcgcgaaagcgcgaatgatcagcatcctggacgccaccctgggggatattccgccatcggcgcggcacgttggtctgctggcgaccaatgcgacgctggcaaccgggttatatcaaaagaaagcgctggcgcgggggctgacgttaattcagccagaagacgcggggcaggcgttggtaatgcaggctatttatacgcttaaacgtggcgataaaactgcggcgcaagcgctgctgctgccgcaaatcgatagccttattgcccgtggcgctcaggcaattattatggggtgtaccgaaattccgcttattgtggccggacatgaacgcgcgatagcgtgcccgatgattgattccacagcgtcgctggtgcgcgcggcgattcgttggtatgagtcctggccagacacccgcgcctctttgaccggggaacaacgccttaccgcctgatgtgtttacagcgcggcctgaagcccacgcaggtcgcgccaaaatgtttcggctacctgactcatgcgggtattcatgcgataagcataagcctggatcgggataaccagttcgtcggcatcaagcactatcaggcgcccgtcggtaatctcctgacggatagcatactcgggtaaccaggcgattccgcagccgtccatcgcaacctgttttaacaattcactcatcgaagagacgaaaaatgtactgaaactcagttcagcatggcgagtcagggtacgatttatcagccggcccatataggagttttgactgtaattaagcaggggaaagtgcggctgctcaagcgtatagcgcggctcgccccggccattgttggcgcaaaccggaaacagtctcgactcaaacaggcggatattatcaaacggcgcttgttgcaggttttcatcgtgataggaaaaaataaaatcgctttgcccctcacgtaacatatccaccgcctggtcgacatctatcgcctcaacggcgtaggtaaactgcgtcggcatctgcttaacgatggtcggtaacaggccgagggagagcgagtgggcggcggcaatcttgattttacgcagcgtataatcgctgccgccgcgcagttcggtcagattactttccagctgctgtaacaggtggcgaacctgggagtgaaagattttaccctgttcggaaagctgtagcggcgagacctgtcggttaaacagttcaacgcccacggcatgttccagggcgcgaatccgccggctaaaagcgggttgcgatacgttgcggataatggcggcctgagagaaattgcggcacttttccagcgtcagaaaatcatatagccattttgtctcaatattgtgcaaacctgctccagttacatccatttaccgttatcctgtcagccgtccgaaggggcattctacgtccattcgggcggctgacaaccacttatcccgtcctctttcagaatgccgtgatggggcagtctgaaactagcgggaattacgccggttcaaaggtaccttttacgcaggctttcccctcattgaccatgcgtttgccgcgcgcatacacctgctcaatgcgtaaatctgcgctaaagacgagcagatccgcatcgttaccgggacggatttcgcctttgccgtccagactgaggaaggcggctacgctggttgtcagcggacgcagagcatcggtcaggctgaatccgtagtggttaaccagcgtctgcaacgtctccagcaaactttcgaagcccgcgacgccgatacccgtcagatttccggcagcgtcaaatagcggctggctgccgttgccgtctgaactgagcgtcacccgggaaagcgggacgccggcttttaccgctctggcaatgccctccgccggcgcgacgggatccgggatactggtggtaatgtcgatcacgccgcctttaagcgcaaacgccagcgcctgctcgaaaagcgattcgctacggttgacgtgggtaggcagcagtttaccgatcggcacgtcgctgttttccaggatgtcatacagcggctgtaacccttttttgctgctgcccatatgaaaaacgctgacaccgggtttgccgcccagcaggccgccaacgcgtgattcggctgccatgctggtgagttgattcccgccgggcgcggcggaacggtggtcggagactgcgcatttcacgccaatgacgcgatcgatcagcgcgacgtctttttctaccgagccagtaatggtcggcgacggaacgtgataagcgcccgtgagcatccaggcggtgatcccctcctcatttagcgctcgcgttttggctaacagcgacgcgggatgacggctgacggagtcggtgccaagcaggccgacgaccgttgttatcccggcttccgtcaggcggctcagagagacttccggcgtccgcgtcgtcggccccgcttcgccgccgccgccgatcagatgaacgtgttggtcgataaagcccgggcacagcatacgaccgctaagattaatcaccgcacagtccggtacgatatcgccggggatgtcagcgccgacggcaataattttgccattcgcgagcagaacatcgcagatgccccggtcttctggcgcaaacaggtgcgcaccctgtaacaaggtaaactccgcggcggataaatcaggcatgataactccttattaaacaataagctgcatgacccagatcgacagcagcgcattgatggcgcagactgcgataatatgcgggtaatatttggcgttgacttcggcagtaccgagacagcggccgacattctgtaccgggtttcccatcaggtaaatggctggcagtagtacggtaacatcgtggccgcttagcgcgccggcggtagccagactggccgccacgccaacggcgccgcccatactcatcagcgaagccagaagcaccgtagccgcttcgccgggaagcccccacaacgccatcacgggctggcagatatggcctacccagtcgagcagaccggtaattttcagcgcctgaataatgacaaatgccatgaccacattgggtaacaggttggtcgtggcgatggtaaaaccgcggcgtgcgccatcgataaacatatccatgacattcttacgtacctgagtcgtcatgattgggctccttgcgcagggtgacggcgttcttcgatgttaatccagatgcgcaaaaggtttgcgccgataaatttgaatagcagaatgaccaccagcggaatgatgactgacgttcccagaaaggcgaataccgcaacgccggaggagaaatagttggtgataatagcgctgccgctggtctgccaggcggcaaaaatcactttatcgcgttcggtgatttcgccttcctgcgccagctctttggtcatacccgccgcggcgtcggtattttgcaggttggcgatcagcgccagtgagcaaatgccgggaatgccaagcaatggtttcaggatgggcgtcatcaattgctgtgccgcccgcagaccgccaagcccatccgtaatcgcgatgatacccagagaaaggataaccgacggcgccagctccagcgcaaaaaggaagccatctttcgcgcccgttccgcccgcgccgcgaaaggtctgcgtaccggtcacatgaccgaatgacccgttgagtacggtaaaatcaaaaacgcgccaccagccttcgcttccggaaaatacgccggaaaagaaaataatggtgagaaaaaacgccaggtatccctttatcccgaccttttctgtatcaagcggcatggccgccccgtccacttgttgcgccatagcgatccccgaatttttttgatgatgtgttggttgtagccacaggccaaaaagcccgaaacagaaagaccttatcagccataagggtaaggacaaaatgcaagtatgtatcgtgctatgcgtttcttgcatagcagcgcgaaaaatcaccatcctcgctactgccggaggcgcggggaaccgtggacggtataacgcgcggtaaaaaagcaaagaaacaggtgttgacgcaggccagagccgggagcaggaaaaaggggaaataaatttgacgttagtcaatttcacgccttaagaggaattgtcacggtcaggtcagtagccgctgatgggtcagcttgcgccctaagaatcctacgggcaggtaataaaaaacgaataatcgaattaatttcatgatgtgatttatttataattgtgatgatttgagagggagcgataatcatcataatggaatatatagccaaaataattcgagttgcgtaaaggcggcaagggagtgagtccccaggagcataataacgatgtgactggggtgagcaacggcccgtcagggcgaggcccatggatgggccgggtaatccgtagccaacacataagccacttgaagtaggaagggtatataaaataatagacagattgataacactaaaaaccatagaataagtatagtttttagtggcatctttaccttgaaataacgtgttgaggatgtgctattaaaaacagatccgcattgcgccgcgaatagcattaaagatacaacccggtgcggatagcgcgggtttactctaccgcttattcacgtatcacaaaccgtttttgttttatctgctgcgcggtgctgatcagcgcggcaaaaaagagcgccgcggcgccgcaaagcgtggcgttgataattgccgacgcgccattgcctgacagactggcggcgagcggaccgagaatttgcccaataccatacgttagcgtcaccaggcctaacaaattaatattgcccggcgcgctgagctggcgggcaagcggcatcaccagtgaggttgtgcccataaacgtggcgccaaaaccaatactgctcagtattaacagcaacaacgagtcgctggcgagagacagcagcacgcaggcgctctggatcaacaggttcgcggtcagacatggcaggacgccccaatgttttgccgcccacagccagccgaagcagccgggaatgatcgccaggccgaccaacgaccaaaggtgtgccgtgagtagcggagagcccgcgcttttcgccatcagcggcaaataggtagcgacaatgatgtagccgaatccggcgaaaccgtataacagcgccagttgccaccaggacataggctgattttcgattcttgctaagggcgcaggcggcagcgcatgagcgcgggggggaatcaacattgccacgattaatagcaatataccggcgagcgctccggcccccagccatagcgaatgggccgaaagcgcataatgtaaaccgccaatgacatattcgttgcccagtgcaatcccggccccgacgccggaaaagagcgcggcgatcacaaacggatggcgggtatgatgcaacacaatcattgatccaaaaatcatcattcccgcactcgcgacgcctgccaggaagcgcaccaacatgacgaccgcgggctgagtaaatatcgccatagacagaataagaataccggtggcgaccgccgaagccagcagcatggggcgtagacgagaggggagatgaaaaaggccaaaggaaaacagtaagcttcccgccaggtaccctgcataattggcgctggcaatccaggagagttggttaaacgttagctgcttttccgccagcattaccggcagcatgggcgtatacagaaagcggccaactcccatccccagcgtcaataccatcataccgaaaagcgccgtaaaaatgggatggcgaggtgaagcgctctgagcatgaaccatggtttttctctttgctaaagtaaggcaggaatgccggattgtcgttgtaaatgataataaaaagtaaaattaatgtttcaaatttgcaagaaaagaaagtgaagcgcaggcgaataacggattgagaagaggggcatcggtgggaaatggcattaaattaatgcctcccacgtgcggggtttggcagttaatctgaatgagaattgcgccttccccttcttagatactgagcagtgccggtatttgcgacagtaaatataacaccagaccaatagcgccgccgaccagcgtgccgttcacgcggataaactgcaaatctttaccgatattaagctcaatctgctgcgacatatcgcgcgcatcccagccttttacggtatcgctgatgtggcgcgtcaggaaggcggcgaattccggcgcgacgcggtgcgcggcctgttccagatgaccgttaagcgaggcgcgtaatgcgtcgtcggcgatcagcgtctcgccaaaccattgtccggcatgagcgatgcgctgcttcacctttgagtcttcggcgttgatatctgtttttaaccactggcgcagatccgcccagatctcgccgagatagcggttaaacgcctcatcttccttcagataacttttaatattttctgcccgggcagccatttccggatcatgtttaagcttatcgatcagcttatacgtcgcacgatcgaaggcatgacgaatctgatgtgcgcggtcgtgactgatatcatccagcagagaattcaccgcgtcggagaccagttcagcgctgtgttctcccagccattcggtcggcagaatcttcgcttttaacggatgctcggtttccagccagcgtatgatctgtctggcgataaatgttcgggagctgtcacgttgtaacagggcgataagctgggcgatcagcgtatcgagtaacacctggtgacgatcgtttttggtcatgctttccagcatcagggcgctggtgccggaaagatccactttatcaatcgccttatgtaccgctcgcttgagcagccgctgaatacgggcgtcatcggttagttccagaaagccgctcataatttgcagcagatgctgcccgacccggctggcgttgtccggctggctgaaccagtttccaataagcagcgcgggttcatggcggcggattagcgcgatcagcgactgcgtatcaaggaacttctcctgtacaaattgcccaagattttcgccgattcggtctttgttacggggaataatcgccgtatgtcgtgaaataaacggaatgggaatgcggcgaaacagcgccaccacggcaaaccagtccgccagcgcgccaaccatcgccgcttcggcaatagcttttacgctcagcacccaaaaactgggcggcaggaaaagcgtggtcacaaacgtcgcggcggctatcagcaacagtgagagcgccaggcgtttggcgcgtttgagttcggcgattttattcatagggttaaggatagagccagacggcaggaacgtgcaaaaaatatcagatgatcctgtgccggataagcctctatccggcagagtgtttacttctcagcggccagttctgccgcctcatgctggcgcacgcgctgtaataatgtcgccagggtgaagaccacaatcaccccggccaccgctgccagcaggtgaaacggcagtctcccgccgtgaaaccacagccagcggccaacttcgaccgacaccgccatcaccgtcagaatcaccatgttcagcgaggccgaaaccgtcccttttggcaagttgttggagaaaagcgtgaagcgaaacagcgtcgggaaaatcattccaatgccgaacgcgtacaggctggtgcccagcacagaccaaagccagacgtgcggcagaagaagattaccgagaagcaatgtcgccagcccgcttaactggattggtacggcgcgccagataaaacgcggtcgggttggatctttcaccaggcgcacaacgatcatattggccacgatcaccgcgccgaatactggcacctgcgcccaggcgaattgcgaagtactcatcccgccggcatcgatcaggatcaccggcgacaccgccacccagctcatcatcgggatgtagctcaacgacagcgtcgccgccccggtgagaaaaatcgggttgcgaaacacattacgaaaatcgcgcagtacgctcaccgcgctgaacggcaccgcgccgcgttgcaccgtttctggcatcgccagcagcaggccgcacaacgccaacagtcccatcaccgcaataataccgaacagtaccttccagtgaacgaagtgcatcagcgcggcgccggagagcgggccgataaccggagcgaccagcacaatggaggtaataatcgccatcagcttaatggctttggtttgaccgaaagcctcctgtaccgtgacgtagccgaccgttgcgataaagcaaatgctggtgccctgcacaaaacgggcaaccagaaactgcgtcattgaggtcgtcaacagcgtagccgcgcaggcgagagtaaaaattaatgcgcctgcaatcagcactggccggcggccaatcctgtcggatagcggccccagaagccattgcaacgccattcctcccgccagatagagactgaccgaggccggcgcaagactgacgtcagcattaaaatcgcgcacgacgttaatgatgccaggctgaatcagatccgtcgtcagataggcggcaaaatcgtacaaaatcagcgccatcgggaaaaataacgttgtggcgcgttgggagaaaaactgaataatccgttgcataaaaaatgcgctccatgtcggagaaccccatgatgggacagcgaaactcaataccgtcatcgtgacgtcaggcaggcgatggaaacagcggctgcggatgtactgaatttcatgtaatcaaaaacgctgccggtgaaaacacagacaggaagagacgcgttctgaatctcgtcagaacgtgtggcgattacagataacaatcagcacatcacacctcgggaaatttacgttgcacggaaaatatacacattaagtgtaattaaattttgatgttaatcaaaagagtttgtctggttaataaagataaaggcagggcgcgcaggctggtattttgcgtgttcagttccgaaaatgcatgtgcattacagataacaggatttatctttcgtcgcgcctcgcaatgctgaaaaggtacggatgagaaaggaattttcaggaggtagagtcgcagcatcctggttttgggtgacggagcgccatgaaaaaatcgacgacctcaacaccgcatgatgcggtgtttaaaacctttttgcgccacccggaaaccgcccgcgattttatggagattcatctgccggtgtcgttacgccagctttgcgatctgcggacgctaaagctggagcccggcagctttattgaaaaaaatctgcgagcctattattccgatgtgctttggtcgctgaaaacgcgcgagggcgacggttatatctatgtcgtgattgaacatcagagcacgccggatgcgcatatggcgtttcggctgatgcggtatgcgatggcggcaatacaacagcatctggatgcggggcataagcatcttccgctggtggtgccgatgctgttttatcacggtgttgatagcccgtatcctttttcgctgtgctggctggatgagtttgcgaacccggaagtggcaagaagactctatgccgctgcctttccgctggtcgacattacggtggtatcggatgatgacattatgcagcaccgccgcattgcgctgctggagctcatccaaaaacatatccgccagcgcgacctgctgggactggttgaacggattgcttcgctgttagttactggttgcgctaatgacaggcagcttaaagcgctgtttaattatcttatgattcagcacggacatacgcctcgtttcaccacgtttattcgtgatgtggtagggcatgtcccgcacactaaggagagactgatgacgctgatagagaggatccgcgcagcggatcgcagaaaaggggaacggcaaggaagacagctcggtctggaggaaggattagcagaaggattagaaaaagggctggaaaaaggtcagcatgttgccgcattgcgtatcgccagacagatgctggcggacggacttgaccgcgagactgtccagcggttcaccggccttacggctgaagagcttcaggatgttagtcactaacgcggctccagtctgaatgttgcaggcccggtgcccaccgggcaacgcgctctataattatcgttgataaccgtacgaatataccgaactttaccgatagcgccagccatctctactacccttattgttctgagcggcatttccggctgccttaatgacgataacaaggagacatgtgatatggcttaccagacagtgaatcctgccaataatcagctcattaaagagtatcccccgcacacggacgcggatattgaagccgcgctgcaaaaagctgacgcgctctatcactccgactggtccaggggagagattgaccaacgtttgccggtactgcataagctggctgacttgatcgacagccgtgttgaagaactggcaaaaatcgccagccaggagatgggcaagctcatcgagcaaagccgtggcgaagtcaaactctgtgcgcagatcgctcgctattatgcggataacgcgaagcagtttcttgtcccggtgccttataaaaccgagtttggcgacgcgtgggtagaacatcatccgattggcgtcatcatggctgttgagccgtggaacttcccgtactatcagttgatgcgtgtgctggcgccgaacctggccgctggtaacccggtgctggcgaaacatgccagcatcgtaccgcactgcgccgagacatttgcccatctggtgcgtgaagccggcgcgccggatggcgcatggaccaacctgtttatttcctccgatcaggtggcgaatatcatcgccgacccgcgcgtgcagggcgcggcgctgaccggatctgaaaaagcggggagcgccgtggcggcacaggcggcgaagcacattaaaaaatcgacgctggaactgggcgggaacgatgtgttcgtcgtgctggacaatgccgatcttgagaaagcggtgaaaattggcgtgcaggcacggctcactaatgcggggcaggtatgtacggcggcgaagcgctttatcctgcatgagaaaatcgccgatcaattcctcagccagttcaccgaggcgttcaggaaggtgaaggtgggggatcagatggacgcttctaccgaactggggccgctgtcgtcgaaagatgcgctggaaacattgaccagacaggtcgaggaagcggtgaaaaatggcgcgacgctgcacgttggcggcaagccgctggaaagcaaaggcaacttctttgagccgaccattctgacccacattacgcgtgacaacccggcgtactttgaagagttcttcggcccggtggcgcagatgtatgtggtgaaagacgatgatgaggcggtaaaactcgccaacgattcccactacggccttggcggcgcggtgtttagtcaggatattgagcgcgctaaacgcatgtgcctcccggattgaaaccgggatggtttatatcaactggctgaccgacaccgcagcggagctgccgttcggcggcgttaagcgttcgggcttcggacgcgagctatcggatctggggattaaggagtttgtgaaccagaagctggtagtggtacgccgctaatccctgttgcccctctgaaaacgggaggggcctggcttttttgcagcgaaggacgcagatcttaaatcagaacgaaataaacgaacaaaacaccctcaatcgccctccttatttatccacgttgcactaaccgtgctttttatcccggtattgtttgtacagacattcatgatgcccgcattttctgttctatgcggaggctggtatggaattttacgagaaccgccccagacaaccattcattggctatgtgcagctcagacgggcgctaaaaaggtggtggctgcgtaagcgggcctgtcaggcgctgcgacgaatgagtgacgagcagttaagggatattgggttggaaaggaaggatgtggaatagtgaatctattcaagggcaatagtaagtaaaggattttatgatatattactatgcccttatgttatgcgtgctcactattttatatcatttatattaatatcattaatctttttctcaatgtatttttctggttttattttggttttttgctcaattgcatgatatttttccttatcaatggttatagtcattttttcttttttgttaaatatgccagggataataatcgcggctgcaattatcaataatattattattgctgcatgaattttgcctttgggaaatgcttttaatatagtacacaggattgttatacccttatgtataagataaggaaaagatagaaataaaacaaatgggtaagcaaaatttatgacatgtttcccatagtaattattatttgttgttagcgaaccaatacagaatgccatcacacaaaatagaaatattccgaagcataagaaggatataatgaaagaaccttgcataattcttttgtgcaactcttgcaaaatactatttgtgagcctttccagtttagtgttatgacaaataactaccaacatcgcaaaaaaaatctcagataaagcaagcgaaaataacgtattgaaggccatgtagctcatcagcgtttcgaaaaatatactttgctgaagatagtatggcaatagagcgttgacctccataaaaaaagtacatagaaatccaagggcgacataagcaattaagccttcatttctccaaagcgtaatgttttcttttacttttagccgcatggttttccttcactcattgatatgaattataattaaagctggcaagggttctttgccagcttattttatgcgtttacttagaacctgccatcacgctgataaacgcctgcacctgcttttgcttacgcgccgacagcttgcacgcctggcgcagcgactgcatcaactcgctttcttctggttgcggctgctgtgccgtgagcacaatacagccgttcatcaccctcacatccacctcggtaccggtggcgaaaccggcggcttccagccactggcccttcatggtgagggcgggaatgcgggtataatccggataacgactcgcataactcacggtaaggtgacggttatttgttggggatacttctggatcgcacggatctgcaatagaatggacggtagtcatgatggctattctcctggaatagtgattgtgatgagcgatatggccgtgttcccgcacggccatatcgcgctaaatacctgtatataacatcagtaaataaaagaaaagtccagctgaaaatagactgtaatgggaatgttcaggaagaaactggatatatttttgatggttatgaatgcgggggaataataaaaagcgcaccgggaaggtgcgcaggaaaataagcgtcaggcttttttacgcgaggtttttttaccaccgctggcggcgcgttcggccttgattttttccagcagggcggcggcgctgttttcaccgctgataagacttgggttttccgcacgccactgggcggtaagctcgccgcggaaggcctttgccaggattgactgggtgaggctgttgacgcggttcagggcgttgttaacctgcttttcaatggtgtcggcccaggcgaagagttgttcgacgcggcggacgatttcgtgttgttcttctaatggaggaactctgatgggataatttgctagtgcttttcctgtaaggtgtttaattgtagttcctgtaaagagctgagataagctaatgttatttgaatcatttttcaaattataaactaaccattcggggatgattttgtcttttacccgtgctcgatgtaatgctttttggaaaataacaggtatgtcctgaggttcactccatatagcacatcgaccaggttcaccaccttcacatattaaaacatcgccaagcttgagtgataattctctgcgctctatatctgaaattagtatatcttgaaggttttctaaatcaaaactaaaccagcgaacatttatatttccaagatattttgttgcagagccaaaatttttagctttatcaagcattttacctagtctgctatcaacaagttcagagtatttatgaacactccaagttgatggtaggtctggccattgccattcactacataatggatggtggtttcttttatttgaaccaattaacaacccgcttaccgcagcagctagcaccgcctgacgaaaacgtttcaggatttgtgggatttgctcaagacgtgctttggtgctgtctacctgtgccagcagcgtatcgagtttttcggcgatgattttttgttcggctataggtggtattggtactgtaagtgttgataacttttgagcattaacattttgtacagcattccctgctgacattaaagacagctgattccaatagtcactcgactctaaaaaacgttttaagtaatattctgaaaaataattaactggtttaaatcgaataaggtatgaagcaaaaacaacttggcttggagggttttgtaccaaaaaactaaacccaaccgaaccggctcgagatatcacaatatctctgtcctgtaattggtattttgaaacatcttccggggcatccatgcaataaggtacactggaccagtcaaccgctccttttgtaatatcggttgttcttaaaaattttacatcccccatagagcttgacttagttgtgtagccatattgaggcttactgcatatttctgaaagatgggttgtcacccacccctccggcaatttccccccactcattccttctcccccccaaacgcttcttccagcaactggcgctgcgcatccgcctcatcgcccgcgcccagctctcgcatcagtgcatccagctcgcccagcgcctgcaccagctcgcccatcgcttctgcggctaacacgtccggttccggcaggctgtcggcgtcgatgctgtccttatccttcagctaggagatatccagcgaatcggattttgccgtgcggatccactcgcggctgaacttgcgccagcggctggtggcctggtgctgatcggtgtttttgttctcttcgctgtcagcaacttccgtctcttcagcgttaaaactccactcaccttcggctcgtgggcttaagccgtgcggatcctcaccatagacggtttcaaacggctgcaggtattgctcagtaaacggtgtacgcttaccaaatctcggcatattggtgcgcaggtcgtacacccacacgtcatcggtacagtccttatcctgagtcggattggctaccgtacctttggtaaagaacagcacgttggttttgacgccctgggcgtaaaagatgccggtcggcagacgcaggatggtgtgcagatggcatttgtccattaaatctcgacgaatttccaatccaactcgatcaaatagtacgttatccggcaccaccactgccgcacggccgccggggcgcagggtttcgataatatgctgcataaagcaaagctgtttgttgctggtcgggtgcacgaaggtgcgggtaatgttggtgcccgcggcgctgccaaacggcgggttggtggcgacaatatcggcctgcggtaaattctcgccgtcgctgcccagcgtgttgcccagacggatggcgccgccgtggtcgaggttgccttcaatatcgtgcagcagacagttcatcagcgccagacgacgggtgccgggcaccagctcgaggccgataaacgcgcggtggatctggaaatcctgggtgtcgccatcaaggtcatccagatcgttggtctgcgacttcacgtaacggtcggcttcaatcaaaaaacctgcggtcccggcagccgggtcctgcaccacctcacgcggctgcggcttcagcagatgaataatggttttgatcagcggacgcggggtgaagtactggcccgcgccggatttggtttcgttagcgttcttctgcagcagcccttcgtacatatcgccgaagtcgtcgcgggacttgccgcgtgtaccgctgtaccagtccagcgaatccatgttgctgactaattctgttatctgtttgggttcagtgatggttgtacacacattatgaaataccgcctgcaccagttttttcttatcttcccccagatgcaccagcattttacggtaaaactgcaactgctcctggtcaatgcgcgatttcaggtcatcccagcggtagccttccggcaggtagtccgcttcctgaccggtctctttgcacattttcaaaaacagcagcgaggcgagttcattggcgtagttttgataggagacgccgccgtcgcgcaggttgtcgcacagtttccacagcttggcgaccagatcgttattgttcattgaagatcccatttgacatggcgaccaccattgtgggtcgcaaaagtgattgagcatttcagatgcctgatggcgcttcgcttatcaggcctacagggttacgtgtaggccggataaggcatcgccgccatccggcgaaaacggggatgataccctcttaagccagctcgtcccagatataatcgctgaacttatccagcacgctgtcgaggttgtcgtcaaaggtgcgctgtaacatggacttaccgccgcgacggtggaaattgccggttttgaagacgtcgtcgtcgagcaccactttctctttcagcgcctgcgctaaacggtcgagccagcttagctgctcagggctccagtcgttctcgcctttgatacgcgccagcgcgtgatcgacacgctcgtcgaacggtttgagcgcatcgcccaccgccgcacggcggatatggccgatcaggcgggcggcaatatcttcattgcgtgtttctttccacgcgctgcgcagagaggactcttcaaaatgctggcggtcaaaccactcctgcaattccaccagccctttacgggtgaggtcacgcggacgattgatcaccgcctgcagcgccgactgggcgttaggggcgtgttgcaccagcgcatcgaacgcttcgagaaagtcctgcggcgtatcgtagtcgccgtacagcgatttgacgctcaccacctcatcgtcaatatcgaggaagatcggcgcatcgcgcagggcgttgatatcggttttcagcctttcgaggcgggcgataaaaccaggaagcttattgaaaatctcggcgctccagtgcggccctttttcccgcaggcgcgaagccagaccaccaaagttaacgcccgcggcatccaggcacagttcgtccagacgacgtacttgcttatccaccgtttcgctgtggtcacggttataggtggcaagaccgataatccgctgcagcttagcgaccagctgttcatggctgtgttcggcaaaactgcggccatccgcttcaatggttttgtaggtttctgagtcggtaatttcgttgaccagcgtttgcagctccacctgcggacgcacaaccaccgggcgcatggtgtcgacgctttccagcgaactgtagatatccacgcagtcgtaaatcttaaagctggttttccctaccgacgggcacaaacgcgtggcacggcccttcatctgctcgtagagaatgcggcttttgactttgcgcaggaacacaatattacagatagacggaatatccacaccggtggtcagcagatcgacggtgaccacgatattgggcaaccgctctttgttgaaacggacgatcatgctttgcactttcttcgcgtctttatcggcatcaccggtgatcttgatgatcgcgtcgtgctcaagctgcggatactttttcttaaacgcggtacgcagttcgtcaaccaccatgtcggcatgggcgttggtgacgcagaacaccagcgttttttgttgcccgatgggatccaggtatttggtgagctcgccgcataccgcgcggttaaacgccgggatcaccaggccacggttaaagtcggcgacctcaaaatcctgatcgtcggccagcgtgtcgttgatcagctcgccctgtgggttcaggcgctccacctgttcaccctcggaaagatagaccccatcctgcgcgttgcgggtgacgatctgaatagggggatcctgatcgatcaggtaaccgtcgatcaccgccgtacggtaggtgtagcggtaaaccggttcgccgaaaatctccactgtatgcagcgctggcgtggcggtcagggcgatttttaccgcatcgaaatggtcgagaatgcgacggtaggcggaaacgtaatccagctggctgcggaactgcagctcgccctcggtttgctctttatcgagaatgtagccgcggtgtgcttcatcgacgacgatacagtcgtagcggccaactggcattggctcatcggattgcagcgtacgcttgaccagtgactgcaccgtggcgacgtgaattttggtgctgtcttccgggaatttgtcggtcaaccctttgatatcaaaaatgctgttaaaggtgtcgccgttaatgcgcgtgtcttcaaacgaccccagcgcctgttcgccaagcgagcgacggtcgaccaggaaaagaacgcgtttgaaacgctgcgactggatcaggcggaacatcagggcgatggcggtacgggttttaccggtaccggtcgccatcgccagcaggatctcttgctggccgttaacgatagccttttccaccgcgcggacggcatcctcctggtaatagcgcaggccgagttcgctcattccggggttttcagcaaaccactggttttgtttctgcgggtcgctgcccagcatatccagcagctcttccgggcgatgccattccggcagcgcttttgacatattggtggtgtgtcggacatcgcgataccagataccgcttttggtcttcatcgctgcgcggtattcgcgcccgttggtggagtagcagaaggggattttaaagcgctgtttgccgctggtgtcctgccagctgatttcatactctggcacggcgtcatgcacttcgtcgggagcgtagtgctccagcagcgtgtcgcgtaaaaatccgttatcgaagtatttactgtagcggtaagactcgttgagcttgctgaagacatcggtatttttgcgtttcgcttcaacgacggcgatgggcttcaggccaacgaacaatacgtaatcggcaaagcctgtttttcccgtttcatctgtacccgttggccattcggcaatcgctttattgacgccgggttccgggcgagcgcctttggcaaagcgcagcgttttactgtcggcctgccagcccgctttgcgcaactgggcgtcgatcaggaagcggctctcttcttcgctgagattcagcgtgcgcttgatagcctgatcggtgatctctttgtgataggccttacgttcctgttcggtttgcttcgccagttcggcatcttttgccgcaagctgtgcctccagcgcggccagacgtgctttggtctgggcttcggtttcctgctgtttgccctcaaggatggcaatgtagccgttgagcgcaaccagtctttgctgctgagcttccagttcggcctgactttgtactttctcttgcgcctgacgttccaactgttgtttcagcgtcagcacttcctggtgataaagattctcgccgtgttctggcagaacaaacatcggcaccgggaaatcgtaatctttggttaccagtcggtagtaccagacgctgaggcggaacccgagccgcaggcacatctgggcatcgtccagatcgttatgaaattcgtggacggccaggttaccgatacggcgcagcttatggaaaacagaaaggatgctgtcatcaataaacgcaatcttgcccagttcgcgtagcaggtcatgttggttttcgcagacgggtatatccagcaactggccgagatgtttcgcggtggcttcgccaaacatgcgcatttttatcagagtggtattaggatcgtccggatagttgttttccgccgcgcaggcgatggcgtaaatgaagtcgttgacgcctttgagaaagtcgaagttagatttgttcatttttatctatccggttcctgagcgagaagacgttattaccttgtgccgtaaagggaaaataacagacccatggtagacttcatattgtgtgtgatcaacgaacaatcagagagtaactgcttctttcctaatgttttcctgaagagtatcgttctccggcggggtatctaatctatatcaatagcagggatggatttatggctgttccaacatatgacaaatttattgaaccagtgttgcgttttctggccactcgacccgagggcgctttggtcagagaagtgcgtgaagctgcagccgaaatgcttgggttaaatgagcagcagcgtgcagaggtgattaccagtggacaactgacgtaccagaaccgcaccggttgggcgcacgatcgtctcaaacgcgccgggttatcgcagagcctatcccggggaaaatggtgtttaacaccagcgggaatgagctgggttgcctcgcatccgcagccgatgaccgagcaggaagtgagtcattttgcttgtgattttaacggcgtaaagctcagtaagccggcagatgcggtggcgttagatccacagccagaatcgattgaggatgatgagcttgccagaagcagcccggacgatcgcctggagcaagcgctcaatgagattcgtgaatctgttgccgaagaattgctggagaacctgcttcaggtttcgccggcgcgttttgaagtgattgtgttagatgtgttgcaccgcctgggatatggcggtcatcgcggtgatttgcagcgcgtcgggggaaccggcgatggcggcattgacggtattatctctctcgataagctcgggctggaaaaagtctacgttcaggccaaacgctggaaaggcaccgtcgggagcgctgaagtcaggggcttttatggtgcattgcctgagcaaaaagtgaaacgtggcgtctttattaccacctcaggctttacggcgcatgccagagactatgctaacaaagttgaaggtctggtgctggtggatggcgacaggctggtgcatctgatgattgataatgatattggcgtatcctcacgtttactcaagttgccaaagctcgatatggattactttgagtagtggtaacgctggaacctgattacgggtaattgagatggaccacgttgtgggcacctgtgtttcctctcgcccagaaatcacgtgactttctatggctgcgtatcagcctaaacccatgccttctgcggcctactcttctggtcaattttcttttatctcgaatacgcaaattgtgaagctatttccaacaatccaggtataatcgtaagataattgtatatacatttttgtatatacaattagggaaaacacatgccgatggagtttgaatgggatgcgaacaaggctaaaagcaacctgaggaagcacggtgtccgctttgaggatgcggtactggtgtttgacgatccccgacacctgtcacgtcaggagcgttatgagaatggagaatatcgttggcagaccctcggccttgttcatggcattgtggtcattctggttgctcatagcgttcggttcgaaagtggttttgaagttatccgtatcatcagcgctcgtaaggcagacagaaaagagaggaatcgttatgagcatggttaaacataaacgcggcaacgcatccgcgctgagtgctcagcatgaggctgaactgaaggcgctggcgaaaaaatcagatgatgagattgattacagcgacattcccgcttcggaggatggacagtggtctgaagcagtgcgtggtaagttttttcgcccgttaaaaactcaggcctcggtgcgtattgacgccgacgttatggaatggctgaaacggccaggaaaaggctaccagacgcggctgaatgccattctgcgcgaagcgatgctgcgcgagcaaaataagaaatagccagaagatgccggatggcggctgcgccttatccggcctacaaattcccgccaggccagataagcgcttaatggttacttccttaaccccgcaaacgccgctctgatctcgtcttccggcaactggatcccgataaacactagcgtgctatgcggcgtttcgtcgccccacggtctgtcccagtcggcgctgtagagacgctgcacgccctggaacagcagacggttgggttcgccgtcgatccacagcatccctttgtaacgcagcagtttatccgctgattccagcagcaggttttccatcacccgcgaaacctcgctgatatccaccgggtaatccagttccaccacaattgacgacacatcgttctgtttatcggcaataaagtggaaacgcggttggcttgccagcacgttctcttccagcataaagccgctggtattaaacaactgactcaggtcaatatcgccgtgtaccacggtgtaaaccggggcgcgggcgttgatacgcgccagccgctcgcgcagtttctcgctgtcgcctgccacgtcggttttggtcagcaggatacggtcggcgtagcctatctgcgactgggcgatggtgaactggttcatctgctcgttagcgtgcaccgcgtcgaccagcgcaatcacgccgtctaacaggtagcgttcgcataatacgtcatggtagaaaaaggtctgaataatcgggccggggtcggccatgccggtgcattcaatcaccaggcggtcgaaagcaatatcgccgcggtcgcggctgtcgagcaggtctaatagcgcatcttccagctcgttggagcgggtacagcagatgcagccgttagtcagggttttgatctgtgtggcgcgatcgccaatcagttgatcgtcaacggagacttcgccaaattcgttttcgataacggcgattttaaaaccatgttgttcgttgaggatatggcgtagtagggtggttttgccggcaccaagaaaaccggtaagtagggtaactgcaatcggggtcatagtctctccattaacaacagcgcataccgcctttgccatcgccgccgtaacgtgcttgctgacgttcgcggaagaactcttcataggtcatgtacggcttgtcgggatggttggttttcatgtgctcgacatagttgtcgtagtccggaataccaatcaacatttttgccgcctggccgagatatttttttgcctgacctaaagtatcaaacattctgccgtcctgttaatgaataaagccggatggcggcttgcgccttatccggcctacactagccggaatcgctgtgcgctacccggcatcagttttagtggtgtgaagagatcttcacgccgccttccggcacgggcacatacggggtttctttatcggtacgtttatcgctgttgcgtaccttcatccaggtggtgaaaccgtagaagataatactgtacaccaccaccaggaacagaatactcaaaccagcgttagtgtagttgttcaccacgatatggttcatattggcaatctgctgcgcggtcaggttggtgccgttggcaatcttctctttatacaggtttgccatgtagaagaaaccttccatctgtgggttggcgctgaacagtttcaggcccagtgcccaggtggtgcagatcagcagccataccgccgggattaccgtcacccagatgtacttggtgcgctgcattttgatcagtaccacggtgctcaacaccagcgccacggcggccagcatctggttagagataccgaagagcggccacaggctcttcacgccgcccagcgggtcgaccacaccctgatacagcagatagccccacaaaccgacgcagcctgcggtaccgatgatacccgcgaccagagaatcggtttttttcaggaacgggacgaagttacccagcaaatcctgcaacataaagcggccggaacgggtacccgcatccagtgcggtcaggataaacagtgcttcgaacagaataccgaagtgataccagaagcccatatccgccatcggcaggactttgtggaacacgtgcgcgatacctactgccagcgttggcgcgccgcctgcgcggttcaatactgacggttcaccgatatctttcgcagtttgcaggatttgttccggggaaatcacaaagccccaggagctgacggtcgccgctgcatgtgcagtaacgtctttcaactgcgccataatcagcggcgcgttctcgccgcccatctcgtgcaggtttggcatggtaatgcccagacctgccggcggggtgttcatcgcgaagtagagacccggttcaatgatcgaggccgccaccagcgccatcaccgcaacaaaggactccatcagcatcgcgccgtagccgataaaacgcgcatcggtctcacaggccagcagtttcggtgtggtgccggaagagatgagcgcgtggaagccagagacggcgccacaggcgatggtgatgaacaggaacgggaacagagcgcctttccacagcgggccggtaccgtcgacatactgcgtcaatgctggcattttcagttccgggttgaggatcacaatccccagcgccagaccgacgatcacgccgattttcaggaaggtagcgagatagtcgcgcggggcgaggatcagccataccggcagcagcgcggaaacaaaggcgtagccgatcagcgcgaaggtaatggtggtgtctttaaaggtcagcgccgggccccagtacgggtcgtgggcaattacgccgccgaagtaaatagacgccaccagcagcacgataccaataacggagacttcgcctacgcgtcccggacgcaggaagcgcatgtagatgcccataaacagcgcaatcggcaccgttgagcagacagtgaagacgccccacgggctttcggccagcgctttaaccacaattaatgccagcaccgcgaggatgatgatcatgattaagaagcagccgaatagcgcgatggtgcctggaacggtccccatctcttctttgatcatctcgccaagagaggcgccgttacggcgggaagagatgaacagcaccataaagtcctgcactgcgcccgcgagcactacgcccgccagcagccacagtgtccccggcagatagcccatctgcgcggccaataccggcccgaccagcggacctgcgccggcgatggcggcgaagtggtgaccaaacagcacgtagcggttagtcggcacgtagttcaggccgtcgttattgataaccgccggcgtcgcgcgcgtcgggtcgagtttcatgaccttctgggcgatgtacaggctgtagtagcggtaagccaccagatagacggaaacggaagcgaccacgatccacagggcgctcacgtgttcaccccgacgtagggcaacgaccgagaggcagaaagcaccgatgattccgagaatcacccagggtatgtgcttgaatatctttttcgtatccatagtaaaacctggttgtaagtttaattatcagccgaagctgggtggacattgagttcgtgtttgaggaggtagattgactgctatgctgagaggatcttgccagatcatcgcgcgcgtaaagttaggtaaatcagtgagtggttgtatggcggtttaagcggtcggacgtaccggtaagcggtttcgcggaggagggcgtgggctattttatgtgattgagatcacgatataaaatgggacgatccttgttgcgcggggcgtcataacgacttcactgagctaatcgtgatattaatggcgcgcatcccataaagttttccctttccaggccgaaaattctgtatctgtctagcggaaagagaaaacatgttaaagcgaattaaaattgttaccagcttactgctggtattggcgctatttggccttttacaactgacatccggcgggctgttcttcaactcgctgaagaatgacaaagaaaacttcaccgtattgcaaaccattcgtcagcagcagtctgccctgaatgcaatctgggtggaactgttgcaaacgcgtaataccctgaatcgcgcgggtatccgctggatgatggaccagagcaatattggcagcggcgcaactgtcgctgaactgatgcagggggcgaccaatacgctgaagctgaccgaaaaaaactgggcgcagtatgaggcgttaccgcgcgatccacgtcagagtgaggcggctttccttgagatcaaacgaacctatgatatctaccacgacgcgttggcggagcttattcagcttcttggcgcgggtaagattaacgagtttttgatcaaccgactcaaagctatcaggacgcttttgagaagcagtacatggcctatatgcagcaaaacgatcgtctgtacgatattgctgttgaggataacaacagttcctacaaccaggcgatgtgggtactggtcagtgtgctgattgccgttctggtggtcattatcgccgtctggttcggcatcaaactgtcgcttatcgccccgatgaatcgtctgattgaaagcattcgtcatatcgccagcggcgatctggtgaagcgtatcgacgtggaaggctccaacgaaatggggcagttggctgaaaacctgcgtcatatgcaaagtgaactgatgcgtaccgttggcgatgtacgtaacggcgcgaatgcaatctatagcggcgccagcgagattgcgatgggcaacaacgatctctcttcccgtactgagcagcaggcagcgtctctggaagagaccgccgccagtatggaacaactgaccgccaccgtgaaacagaacgccgaaaacgcccgtcaggccagccatctggcgctgagtgcgtcagagacagcgcaaaaaggcggcaaagtagtggataacgtcgtacaaacaatgcgcgatatcgcctccagttcgcagaaaatcgccgatattatcagcgtaatcgacggtattgctttccagaccaatattctggcgctgaatgcggcggtagaagcggcgcgcgcaggcgagcagggacgcgggttcgcggtggtggccggtgaagtccgtaatctggcccagcgtagcgcgcaggcggcacgggagatcaagagtctgattgaggattccgtgagccgtgttgatgtaggttcgacgctggtcgaaagcgccggtgaaaccatggatgagatcgtcaatgcagttacccgcgtgaccgacattatgggcgagattgcctcggcgtctgacgagcaaagccgtggtatcgaccaggtgggcctggcggtagcggagatggatcgcgtaacgcagcagaacgcctcgctggtggaagagtccgccgccgcggctgcggcgctggaagagcaagccagccgtctgacccaggccgtcgcggtgttccgtattcaccagcaacagcagcgtgcgcgtgaagtggcagcggtaaaaaccccggcagccgtgtcgtcaccaaaggccgctgtggccgacggcagcgataattgggaaacgttttaagggcgtagtggtgaacagtcggcctacagacgaccgtaggccggatgagatgttcacacttttgcctgatggcgtagcgcttaccaggcctatgcgccagtttattgataaagatgatgtgtaggccgggtaaggcgtagccgcacccggcatatatgacattctcttttaactctcaacattcaccactttgatctccaccatgccaatccccaatttgcgcggcgaatggcccaaaatattaccttcgttggtggagacgggagcgggcggcgcaatgactaaggtattcgcgtccgtcgggttgttgaaatgcagcgtgatagtggacacatcgtgacccagcaccagcgtctgttcttcgttgcctacgcgtaccggaatcggccgattcgcgttgtcgccgaaggctttggcggtgatcaccagatcaaactttttcggcagcggcgctttatattcgattttaacctcatcgcccaactgcgcatttgaccagcgcccccaggactccggccgggaaatgccgctaaactgcttcacctcctccggcgcgcccgccacattaaaaataaagctatcggctttataacgaatatcgttatcgacaatctttaaggtatcgacgttgcctttgtagcgctccatatcgatcatcgtgtctttaaacgccgtcttaccctgccactgcgctttatcaacatgctgtacggtttgctgcccgccaagctgtccctgcgagacgcaccagtcggtagagagcgccagcgccggcgcccatagctgcgccattttgtagcagcgatcgatccaaacgaaattatcgcgcggggcgaagtcggccaactggaaccgtagcggagcggagtattcactttccggtaacggctcgacgcgcttatccgatacgcgcagtagtaacggcaggcggaagtggctcccggaaaacgcgatcatgtttttgtcccgatcgacggtaaaatcttttatctctttcgggaaattccacaggcgaatgatatccggcttcatcgccagcactttctcttttacattcaggaacacttccgacagcgactgcccggaaaggctgctacgtcccagaccgataaaattatcgccgccgagaatatccagcaccgttgcgccgttgtccatcgtgttgcgtttgaccgccagcgtctcctgctgcggtttatcgccgcgcagaatgaaaaacagattgttgcgatcttgcttattcaggtatttccaggccgtattgttcatcgccagatggtcagaagagacgacgataacggtatctttaaaccacggtgacgctttgattttgttgataaactcggcgatgttttcctggctgcaacttacggtgctaaaggactggttgggcttgccgtcgtaatcgtagcgtttacggttgcaggtgcgtgagataaacccgtccgggtggtgagtatctacggtcagcgtaaacagcgaaaaacgctggcctgagcgggaaagcgcttcaaatttcttccatgcctcatcaagcaccgtatcgtcgtagaagccccagtcgttacgataagacgggtccgccaccaccgtttttagctcttcagcgccgtacagatgatcaaatccgtgtgatttcaggaacacgtctttcccggcaaaacgcaggttagcgccctgcacgaaatagttctggtagccggagtttttcagaatatcgccgaggcagatattctgcgggaagaagctggaaaccgacgcggacgcattgccctcaaacggcgcaaacagcggaataccacactgggaagccaccatcccggcgatggtgtaatccgttcccggcagttgcatggtatggctgaaatccagcccctcatttttcagcgcgcccaactctggcgtgagattggggaacgcgtcattatcaaaataggtccgttccaggctctcgccgtagatatagaccagattgagcttcggatgaggaatggtttttgctggttctttataataaacggcaaaatccggatcgccatcgcgcatttgtgattttaccagttcggtaatctggcgaaacgccgggctggcgtcgaccgaacccaacgccagcagtaacgccagcaggctgtaaccgacatgatgaggatggtgacggcggcggcgtagtacccatcccagcgcgccgaataccgccactaacgccagggcaatgccgattcccggcagaatatatttgccgactcccgctcccgtcagactattcgtgagcgtataaagcactgcgtcgttgatcccgtcgccggtaaaatagtcgctggcatacagggtaatattcagaatgacaaaaagtcccagcaccgtgagagtggcggcaaaccaccaagtgttacggcccgccttccaggcatatatcagcacagaggcgagaaacagagcgacagagagcaactcggacaactgacgatcctcaataaaccaggcttatcgctggcaggaaaaaatttctaacaatgtaatagcgatgtcacattgctgcaattctaataactttacacggcgctgttatttagaatgagtttagaaagttggttttttgatcggcatcacttcctgccatagcggttaataacaggaaaagacgaagagaaaagtcgggttaatgccgtgttggcgggtaaagggccaaaacacggcttttaacagggcgtcccggcgtggcgcacggtcagaaaagcgcagtcaggagaggaaattcagcccttgctgcaacaccagatcgcaagctttggttttcaccttttccgccagcggcgtactgccgatattattgaggttcaattgctggccgtccttcgtcttgagcaacccttgcaggccgttcaggtagttagtgtcctgctcctgctgtgtggtatccaaccctaacttgttcagaatctgatttttaacgttttccacgttggtagcggacgccagtttctgtttggcgcagtactgcaaaataccggcggcattattcatattatcagcactgagcgactgggcacctctgctgagcagaccggttagcgcagaaagcgacatcccgccctgctgtgcgttcgcgccctgagcgcttaactgactggcggcaataccgctggtggaaatcagtacgctggcgatcgccgcgcagcacagaacatgtttcgctgtattcatggtaatcacctgtgttatgccagctaggcgtcgtatcgccctggcgcacgttgcaatttaatactctttacccgtcactcggctgcggtaactgtcccagctaaaattaacccataaactgttgccgagacgcatacggtccatgacgcgttcgccaagcattttcgtcatctcttccatattgctgttcgtcaacatgccggtgggacgttttgacgaggaacgacgatcgacaatttgattgatgatcactttttcatagcgggattcggtctgcacgccgatctcgtcgatcaccagcagatcaacgttactcagatcgttaagcaactgctcttcgctggtttcccgattgctgaacgtgtctttcatcgctgacataatatccgctacggtgataatcagtaccgactttccgcgcagcagcagctcgttacaaatagccgcggcgagatggtttttaccggttcccggcttgccggaaaagacaaagctggcgatattgccgtcaaattcatccacgtactgtcgggctttgcttaacgcgttcatttgtccgtcgcactcaacccgatagttatcaaacgagcagttttgatgcagcggtcgaatgccggaacggttaaaggtgcgctgcattttcatcgcccgattttcccgcgccagcgctgccgcccggatctcgccctgctctttctgccaggccagcagttcttcgcccgttttaaacgccggcgtaatatgcgcaggcatcattttttgtagacgctgcatcaggtcgccaacatttttcatcgttaccccctaaaacctggtggaatatgattgtcaggttcgctgacgctattgatgtcgcgctgcggcattccgccattgctggaacggctgatttgcacgctgcgcgccagcttttgctgccactggatatggtgaaaaaccttaccttccgcctgccagtaggcgataaacgccgctagctcttctgcggtgacaggctcccgaagcgccacgccccaaagggcagcctgacgctgaaaatccgcatccggttgccaggcgggatacatggcgaattttccgcagggaatcgcaacgggggcggcttcgggttcttcgtaaaattgcgcgtctaacgccacatcgcttcccggacgtgataacttttcttcaagcgccagcagttcagccatgcgtgcaggcgtcacggcataaaaggcaggcgcattattagcgaataccgccactgcgccgcccgttgacttcgccagcacagcatgatgatcgtgtaaaaggacgtcaataccgatgacgtccgacgttaaaattctggaagacataatgtttctcaatatggaacaacaaccgagaagggcgactgtttttatagtaccacacagacctgtaagaacagcaggaggcgttccaccgatcacacgcgggggcgtttgcggtacagccataatcccggtacagagaggccaattgagagcgcgccaacaatggaagaggctttcagaaaattggtcagcagcgtaatcatcatcggttcgctatagcccagatggctaatttttactgcggaaatcatcgcggtataggcggaaatccccggaaacatcgggatcacggccgcgacggtaaacactttagggtgagcgagataccagcgtgaccactgaataccaatactgccgaccagcagcgaagccataaacgtcgaccattcgatattaaagcctgcgctcatcatcagcatacgcaagccatgacccagcgcccccagtagcgcgcaccacggaagcgcccggtggggaacattaaagaccatcgcaaacccgacggcggggatcgcagacaagatcatgtcctgcattagcgccagtaaaaagtcgattatacccatcctcgtagcccccatattgtcattgacatcactacgcccacacaggtggccagtgtcaacaggctggcgatagcccagcgcgccagcccggtattaatatgtcctttaaacatatctgcgacggaattaatcagcggaaagcccggcaccagtagcagtacgctcgccgccatggcgatagtgggcgtctggctaaaggcgggaagggtgagcatcagcccggaaatcgtggtagcgacaaaggcggtaatgcaaaaattgatctgcggatgtaaatgccgctgcgccagcatctggcggatatacatggctatcatactggcgaaaaaggtgataaccgcgccatcccagccgccattattcagcttacaaaagcaggagcaggaaagaccgaccataaacgccaccagccagcgcggataacgcagcgggcggagctggctaaagcgtttttccacgcctttgtaatccagcagacgatgttccgcgaggataacgatatgctgaacctccgtgacgacgtgcatattaatgccgcgatcctggtttttacgtgtcgatgtcagacattgtccgtctttaatggtcgtcaggacaatggcgttagaggagatcgcgctttcgacgctatctataccgagcgccaaaccgaggcgggtggaaagctcatcaaccagtgcgctttccgccccgtgctgcaataaaagcagcccgcattgaatacataaccgtgttactgctcgttgaattgattgctcttcttgcatgactcgtcctgtccgaaaagacattctatgcgccgccactatgacagaggctttctttttaacacgaagcgcaggcatgatggcgttggttaagatcaatttcttgttgataaaaacgtcaaccaccagacgcaacgcataagcttcctgagacgtgcgcttcgtcacaggcaggatatccttatgggcgacggttctcgtatgtccgtttccagaatagaggcattatgccagtctggccgctcatttttgaatcaatgatgtggtgaattttatcaactatatgcattaatggtttaaccacaatggcgtgagcagcgggtgtaaaaataggcatgacttagtgtaattcgtagatattacatgggttttatggatggtggacagtattgttgggcttttgttttaggactcagcaatatgaatgaagggcgaactcatattttaaatttattaatatgatgcgttttcgttagaattgctaatgtgcaaatttagttaatttaattgtcttgcttctggttttatgagtaactatgcgatagtgatttcatgtttttgtgctatgtggattgtagcgcaatcaatgttagatatttaaaaataaaacaaggataattaatccactcggcctatatttctttgcgatcattgttaatagtgtttttattaatggggcaatgaaaagtggcggcgtgggtgcggaggaattatgctgccaggatgctgcaaaaatggacttattatcagtaaaacccctcttatacaggaaggccttaaaggggctataacaggtaatttccccgattataaactggcgtattgtcgtacgatagaagagctaacgctgctacagctacgccgaagtaatttagttattgctgatttagcagttaacaatgcctctccccgcgctatctgcgaatatttttatagcttaatctcgcaatatcgcgacatacattgggtatttctggttcctaaatcctgctatccacatgcggttgatctcctgatgggccccgtcagcaccttgctttcagacgaagagccaatcgagaatcttattagcgttatccatgcgggaaacgctcgctcagaaagaataagtaaaacgttattatcgcctcaggtaccgtctgaaattcagcagtcccacgacaggccgattgtccttacgctgtctgaacgaaaagtattacgccttttaggaaaagggtggggcattaaccaaattgcggcgttacttaaaaaaagtaataaaacaattagcgcccaaaaaaatagcgccatgcgacgcttatcaatacacagtaatgcagagatgtatgcatggataaacagttctcagggagccagagaattgaacctaccttcggtatatggagaaaccatggaatggaaaacagaatcagcaagaaaaatgttgcgctcgtagaaaaatgcgtgatgagcaccattggtattaaagggctatttgatgcaatgccggattgccgacatacgcttcatattttttcaaaaccatccgcgttttataaggctgcgctaaagacgccgttttctgccgttattttttctctttctgcgttaagaactgaacgccggacaggattatccagcctgacggaactggcgataaattatccccatatgcggcgtctggtgattgccgatgatgatgctgaagcccgcttaatcagcgcattatccccgctgccgctggatggggtcatcagcaaagcgtcgccgttggatgttttacaggatgccttatttacatcgcttaatagcgcccggcggacaacggagcgtacagacaatctttgggaacttcaccagaattgtatgcttagtccaaccgagcgggagattctgcgtttcatgtcgaacggctactcaatgccgcaaattgccgtccagttagaacgtaacattaagactatccgggcgcataagtttaatgtgatgtccaagctgggcgtgagttctgatgccgggttactcgatgtggcggatattctgttatatctgcgcgccggagatgctaccgcgctccagcatcgggtatagcccgcgccggatgcgccgtgcttgttcggggaatccgggtgtcaggcacgttattggcacacgtctacccaggtcgccgatgtcagttcagccattctttccggcgtgatgcgtaccgcgctgtgcgtggcgcctgcggcaggcaatacttcgttataccccttcagagagatgtcgcaataaacgggcagcgggtgctccagcccgaaaggacatacgccgccgacaggatgtccggttgcattgaccacttcatcactgctcaacatacgggcttttgcgccgaaagtggttttaagcttcttattatccaggcgggcatcgcctttcgcgaccaccaggataatggtgtcttttactttaagcgagagcgtcttagctatctgccctggctctacgttgtgcgctttggctgccagttcgacagtcgctgtactttgatttaattcgataatttcaatatcgggagcatgagcggccagaaattgccgtacagattgcagactcattcttctctcctgagaccttaccaatagccacggtagacccaaaaatggcaaaacgtaatttggcatacggagagcgccgctgtaaatataataatgtgacaggccagcagcagtaagccgtgacgataactgaaggcaacgtaaagcggtttactttagcgtgcagtcgccgcactgctgtacgtcaggtaagcggtaacgttggcagcaggttctgcgtaccagaagaccgtcgcgcattacgacggtccgccacagcgggttatcctgaccgtcggatagctgcttttcaaaaaaacagcgctggcgtagcgttgccagcagggcttcgccaagcaacggtttcatctcagtcagataccagttgattaaataaccggtattgctccagataagtttcgcgttgatgtcgccagtcgcctccagcgcctgaatgaccggctgtagtgcggagactattagcgtttccattcgttcttccggggaacgttccgttgccaggttatcctgatgcacatcaagccagaaacacgcggcgcgcccggtttcatgaaattcaacgtgaatatgttctgccgagacattgatagcgcgcgcttgcgtcagtaatgccagcatcagcggcggcgtcatcagcccgatataccattgcgcccacagggagagtaacggcttattttcacgtggcaggcctggcgtgtgccgatagatgtgatcggaataggcggccagcaatgaacgaaacgtcgcggggcgcgtccactgggcaagagtcatcgccgttggcggcggcgtttcatccagccggatgaagtccaacaggtgctgacgggtagaggcgatcgtctcgcgtactgcgtccgccagcgaggcgtcttccggctggggagcagctcgccagataatatcgtcagcaatcggtgcggaacggtaggccatagcgcagtttaatgatgttaatctaaatgataatgattgctaatcctatcgatagcgataaacgatggcaagcggtttatggttaacgctgttggcgtagcacgattacgccaacaggattcatagggcgcgcatgtcgtcgctgaccagaatgtggttacgtccaagatgcttggcttcgtagagcgctttatccgctttttcgatagcgtctccgatattgcgatccgtcaagggcgcaatgccgatactgacagtgacattggtggcgacgctttcgttaaacatatgcgggattttaagatcgtatacttcctgtcggatacgttctgcggtagcgcgggcttgctgtggttcggcggtggtcagcaacaccagaaattcttccccgccaaaacgacagacgacatcgcgcgatcgcacggcgtcccgaattgccgctgagacgcggattaacgcctgatcgcccatcatatgaccgtagtgatcgttatacgctttgaaatgatcgatatccaatagcaggacgtagtgttcatggctgcccggcgcctgtaacgtatccagccgattttgcaggccacggcggttatataagccggttaatggatcaagcatactcaggccattgagggtttcccgctcggccagcagcttaaacatgagctgttgggcaaaattatcgtagcgtttctggataacatgttgaatagcgattcccaccattggcagggccagcaaatagagaattcgcaaaccttgttcattaccgttcaaccacaggcagaccgcgactggcggtagcgaatagagcgtaaacgcgacgatattcgcggcaaaggctatcgagccgataaacagaacgctaagcagggagatcagtaaaaaagagaaatcataatggcctaacgccggatactttagcgcaatacgcgccgcccatattcccccaaagagtagggagataaaggggaggttaattcttttttgcccatatttcccatgccatatcaacagtaatacgctcaggcccactatcccgatcattggcgtgcaaaatacattgatctgataaagggggaaaacgagagtaaatagcgccgacacggcgctgagaaacaagaaaagacgtaaagaaaactgatacttcttaatacgaagcgatcgccaggatggtgttgtcatgggtaattgtcgttatttatcagtgatatacacggaatcgggcgccaacatgaaaataacgtatgagaaaaggtcgcctaaagcgaggtgttgttgtttttacgttaacagtcggacaatttatcaccttactgaatacgtgtcatcaaccgttaagtaaaactcatctctttagctttctccctggctgacaaatgagaaaatatatcatatgatattggttatcattatcaattccagaggtgaaaccatgttgcagcggacgttaggcagcggatggggcgtgttattgcctggagtgattatcgttggactggcgtttatcggcctgtcagcttatgcgctgaagctgttgattgtatcaggattgctactgtctgcgctgatgttgtatcacaaacaattacggcattttgtactgctgccatcgtgtatagcgcttattggcggcatgatgttggcaatgatgaactggaatcagggatgaaaatgaagggacaaaggaaggataagataattggtgcgaggggggggacttgaacccccacgtccgtaaggacactaacacctgaagctagcgcgtctaccaattccgccaccttcgcacagttatcttactttttgatatcgcctcgttggtgcgaggggggggacttgaacccccacgtccgtaagaacactaacacctgaagctagcgcgtctaccaattccgccaccttcgcccagtgcgagcaatatcaacatggttttggtgcgaggggggggacttgaacccccacgtccgtaaggacactaacacctgaagctagcgcgtctaccaattccgccaccttcgcataccatcgattcttgaaaagaatcactaccacggaggcgcattctagtggttttcagctattcgtcaatagttaattgcatgggatagattgattgctgcaaaaatgggcgcgagacgtaggttggataagacgcctggcgtcgccatccggcacatgcaaccagatggcgctgcgcttatcaggccaactatttcttcgcctgacgggtcatcacgatacgataaaccttaaagcgcccggtttgcgcgatgacttcatggaagccaaaggtctcatccagaatcttaggatagggcagaaaggcgttcgccacgatgcgtaactctccgccgctgttcagatggcgcactgcgccgcgaatgagcgtttgcgccgcatcaaggctggtttgcattccgtcgtggaacggcgggttggagatgatcatgtcaaaacgtcctttgacttccgaaaagacgttgctggcgaatacctcgccttcaagaccattagcggcaagcgtggcgcggctggcttccaccgccggcgcgctgacgtcacacagcgtcaggcgcactttcggcgaatggctggccagcgcggcggaaagcacgccagcgccgcagccgacatccagcactttacctttggtgtgcggcgtcagcgtagacagcagcagttggctaccaacatccagtccgtcgcggctgaatacgcccggcaacgttttgatggtcagcccgtcgatattgtactcggcccaccaggattcaagactaaactgcggctgcttttccagacgaccatggtaaaggccgcaacgtcgcgcgctatctactttgttcagcggcgcatagtccgccagcatcggttcggcgctacgcacgccgctgcggttttctcccacgacgaaaacatcgctgcccaccggcatcagcgacaaaatattcatcaactggaactgcgcttcgggtttatttttcggccagtagtagatcagcgtatcgcagtcagcgacatcgctggcttgcgcgaccaggctaaaacggacgttatcgcccatctggcggcttaacgcctgccagtggtgaaactgttgcgtatacgcgcggctggcggcgcattcaaagcgcgcgggcaggtcatcctgcaaatctccggcaaaaagaatacggctttgttcgaaatcatcactgtggcgcagcaagacttcacttgccggggtaaaagcagacatggaatgctccttaattcagactggcggcgattatagtagtttgatggcggagattcgacagatttgctatatttgcgcccctgattacaggagcgtttcgctatgacatcccgacgagactggcagttacagcaactgggtattacgcagtgggcgctgcgacgtcctggcgcgctacagggcgagattgcgatttcccttcccgcgcacgttcgtctgatcgtggttgcagaggaattacccgcgctgaacgagccgctaatgcgcgatattttacgcgcgttgaccgtgagtcccgatcaggttttaccgctgacgcctgagcgcgtcgccatgctgccgcagggcagccgttgtaatagctggcggttaggaactgacgcgccgctccaactcgaaggcgctcaggtcacgacgccggcgtttaatgaactccgggtaaacccggcggcacgcgccgcactatggcaacaaatctgcgaacatgaacacgatttctatcctcagcacgaccgatctccccgcagcctggcagattgagcaacgcgctcatgcgtttccgtggagcgaaaaaacgtttttcggcaaccagggcgaacggtatctcaactttaagctgactgctgatgacagaatggccgcgtttgccattacacaggtggtgctggacgaagcgacgctgttcaatatcgccgtcgatccggattttcagcgtcgggggctggggcgtatgctgcttgagcatctgattgatgaactggaaaaacgcggtgttgtaacgttatggctggaggtacgcgcctctaacgctgccgccatcgcgctgtatgaaagtctggggtttaacgaggcgacgattcgccgcaattactatcccacggcacaagggcatgaggacgccatcatcatggcgttaccgataagcatgtaataaaagaggcaaggtgtaatgatgaagtgggactggattttctttgatgccgatgaaacgctgtttacgtttgattctttcaccggcttacagcggatgttccttgactatagcgtcacctttaccgctgaggatttccaggattaccaggccgtgaataagccgctatgggtggattatcagaacggcgcgattacttcattacaattgcagcacgcgcgctttcaaagttgggctgaacggctaaacgttgcgccggggcggctgaatgacgcttttattagtgcgatggcggagatctgttctcctttgccgggcgccgtttcgctacttaatgcgattcgcgggcaggctaaaatcggtattattactaacggttttaccgcgctacaacaaactcgtctggagcgcaccgggctgcgcgagtatttcgatctgctggtgatttccgagcaggttggcgtcgcgaagcccgatccgaaaatctttaactacgccctggagcaggcggggaatcctgaccgctcgcgcgtattaatggttagcgataccgcggagtccgatattcttggcggcattaacgccggactgtcgacctgctggcttaacgcgcatcatcgcgagcagcccgcgggtatccatccaacctggactgtggcgtcattaagcgaactggagcagctcctgtgtaaacactgattgcctcccccaggttgatgggtaaaatagccgcatttttcgtattcaacatgcgtggtcaaacgccgcgcttactcaagaagatttgactatgacgttgtctccttatttgcaagaggtggccaaacgccgcacttttgccatcatttctcacccggacgccggtaaaaccaccattaccgaaaaagtgttgctgttcggacaggcgattcagaccgccggtacggtaaaaggccgtggctccagccaacatgcaaaatctgactggatggagatggaaaaacagcgtggtatctctatcaccacctcggtgatgcagttcccgtatcacgattgtctggtgaacctgctggacaccccggggcacgaagacttctccgaagatacctaccgtaccctgacggcggtggactgctgtctgatggtgatcgacgccgcaaaaggtgttgaagacaggactcgtaagctgatggaagttacccgtctgcgtgatacgccgatcctgacctttatgaacaaactcgaccgtgacatccgcgacccgatggagctgctggatgaagtggaaaatgagctgaaaatcggctgtgcgccgatcacctggccgattggctgcggcaagctgtttaagggcgtttatcacctttataaagatgaaacttatctgtatcagaccggtaagggccacaccattcaggaagtgcgcatcgttaaagggctgaataacccggatctggacgccgccgtcggtgaagacctggcgcagcaactgcgcgacgagctggaactggtgcagggcgcatctaacgagtttgatgaagagctgttcctggcaggggaaattaccccggtatttttcggtaccgcgctgggtaactttggcgttgaccatatgctggatggtttagtggcgtgggcgcccgcgccgatgccgcgtcaaaccgatacccgcacagtggaagcctcagaagagaggttcaccggttttgtctttaaaattcaggccaatatggacccgaaacaccgcgaccgcgtggcgtttatgcgcgtggtttccggtaagtatgagaagggcatgaagctacgccaggtccgtaccggcaaagatgtggtgatttccgacgcgttaacttttatggcgggcgaccgttcgcacgttgaagaagcgtacccgggcgatattttgggtctgcataaccacggcaccattcagatcggcgataccttcacccagggcgagatgatgaagtttaccggtatcccgaactttgcgccggaactgttccgtcgtattcgcctgaaagatccgctcaagcagaagcagctactgaaagggctggtgcagctttctgaagagggggcggtgcaggtattccgtcccatctccaacaacgatctgattgtcggcgccgtgggcgttttgcagtttgacgttgttgtcgcgcgcctgaaaagcgaatacaacgttgaggcgatttatgaatccgtcaacgtggcgacggcgcgctgggtggaaagcgccgatgcgaagaaattcgaagagtttaagcgtaagaatgaaacgcagctggcgctggatggcggcgacaaccttacctatatcgcccccacgatggttaacctgaacctgacccaggaacgttaccctgacgttcagttccgtaaaacgcgcgaacactgatccctttccgggcgcggcatccgccgcgccttcgtactttccctgcctttttaaccgcttacggaatgttcttaaatcccgcgttttttctccgatctgcctgttttttatacgcaccgacaagcgattttaaaattgtgatctatatttaacaaagtgatgacataaatgtcggctttaatgcctgttcaatgcgtgaatatgagagcttaaagctgagatttgtttcagtcacgatattaataactgaaacggaagggtggcaggcgacgcgtcgttacaaattcacgaatgtgatgccagtcattgacttcagaaaccggtgagtttcaccgcattcagcaatgcaacctcgtgttgcctgagctcaaattacgagcaaactatacaggacaaaatcgatgactatgacaagactgaagatttctaaaactctgctggccgtaatgttgacctctgctgttgcgacaggttctgcctttgcagaaaacgcaacaacggacaaggcgcaaagcggaaccgaaaccgcagggcaaaaagtcgatagctctatgaataaagtcggtaacttcatggatgacagcgctatcactgcgaaagtcaaagctgcgctggtagaccatgacaatattaaaagcaccgatatttctgtcgaaaccaatcagaaagtcgtcaccctgagcggctttgtagaaagccaggcgcaggctgaagccgccgtgaaagtggcgaaaggcgtagaaggcgtgacctccgttagcgacaaacttcacgttcgcgacaataaagaaggttccgtgaaaggttatgccggcgatacggccacgaccagtgaagtcaaagccaagttgctggcggacgatctcgtcccttcccgtaaagtaaaagtggaaacgaccgatggcgtcgtacagctctccggtactgttgaaactcaggaacaaagcgaccgcgctgaaagcatcgcgaaagccgttgatggcgtaaaaagtgttaaaaacgatctgaaagttcagtaattcgtcgtaattcgtcctcccgacgtttgtcgggaggcgtaatgtgcaccacactaaaaatatcgcgaatgagtagcctgagcgctcatatttagcggtcgacattaactatggtaaaggagaggcttatgtttcgttggggcattatatttctggttatcgcgttaattgccgccgcattgggttttggtggactggctggtacggctgccggcgcggcgaaaatcgtcttcgtcgtcgggatcgtgctcttcctggtcagcctgttcatgggccgtaaacgaccctagcaggcagctgtaaagatatattgctatcaagccagtccagcggactggcttttacggttttagccgttaacgttttgcattaccttgtcagcctggaaaaaaatgaaaaacaggaaggcagaggtgggccagcgaataccggttacgctcggcaatattgcgccgttatcattaacaccgttccggtcaggccgtatggcgctggtctgtgagggcggggggcagcggggcatctttaccgcaggcgtgctggatgagtttatgcgtgcgcagtttaatcctttccatctctacttcggcacatcagccggtgcgcaaaatctctcggcgtatctctgcaaccagcccggctacgggcgtaaagtcattatgcgctataccaccaggcgcgaattttttgatccgctgcgatttgtacgcggaggaaaccttatcgacctcgactggctggtggagtccaccgccgcccggatgccgctgcagatggatacctcagcgcgcctgttcgacagcggaaaatccttttatatgtgcgcctgccggggggatgattacacgccgggctatttctcgccgacaaaacaaaactggcttgatatcattcgcgcctccagcgccataccgggtttctaccgtaccggcgttacgttagagggcatcaactatctggacggtggcattagcgacgccattccggttcaggaggcggcaaagcggggggcgaaaaccattgtggtgatccgcaccgtaccctcgcaaatgtattacacgccgcagtggtttaagcgtatggagcgctggctgggagagagcagtctacagccgttggtcaacctggtgcagcatcatgaaacgtcctacagcgcgatccaacaatttattgaaaagccgccgggtaagctgcggatcattgaaatttatccgccgaaaccgctgcacagcatggcgctgggcagccgtatcccggcgctgcgtgaggattacaaaaccgggcaattatgcgggcgttatttccttgccaccgttggtaaattgctcgccgcaacgccgcctctcttgcgccattcgtcgcggattgccgtgccggaaacggtggtcgtgcctccggcaccggtggccaatgatacgcatgtggcggaggtcattagcgcgccgcaggcaaacgacaccacatttaccgacgaggatctggcgtgagctggcgctttatcgatacgcattgccattttgatttcccgccctttacgggcgatgagcgcgccagtattcagcgtgcctgtgaggcgggcgttgaaaaaatcatcgtgccggcgaccgaggcggctcactttccccgcgtgctggcgctggcggcgcgtttcccgtcgctttatgctgcgctgggattgcaccccattgtgattgagcgtcatgccgatgacgatcctgataagctgcaacaagcgctggcgcaacaacagaacgtcgtggcggtaggcgagatcggtctcgatctttatcgcgacgatccgcagttcgccaggcaagagcgatttttagacgcgcaactgcaactggcaaaacgctacgatctgccggtgatcctgcactcgcggcgcacgcatgacaaactggcgatgcgcttaaagcgccagagtttgccgcaaaccggtgtggtgcatggtttttccggcagtctgcaacaggccgaacgttttgtgcaactgggctataaaatcggcgtcggcggcaccatcacctacccgcgcgccagtaaaacccgtgatgttatggcgcggttgccgctggacgcgctgttgctggagaccgatgcgccggatatgccgctaaaggggtttcaggggcagccgaaccgcccggagcaggcggcgcgcgtatttgatgcgctctgcgaattacgtccggagcccgcagaggtgatagccgatacgctgtatcgcaataccgttaccttgtttcggctctgatggcatcgcagccgccgtccggcaggcgacgcttacaaatatagcgccggcaaaatcagcttcgccaccccacgcgcgcgcaatccgtcagccagccgttccacctcttgcggcgtcgcgcctggccaggctttcgcttcgccatagacgccatgcgcatgaaaggcattcaggcgcaccggaacctcgcccagcgaagtaataaacgccgccagtgaatcgatatgcgccgcatagtccacctgacccgggataaccagcaaccgcagctccgccagttttccccgcgcagcaagaaagcggatactgtgcttaatatgcgtgttatcacgtccggtcagacggtgatgacactcgctcttccaggctttcagatcgagcattacgccgtcgcaaaccggcagtagtttttgccagccggtctcgcttaactgaccattactgtccaccagacaggtcagccgttgtaactgcggatcggctttgagcgccgtaaatagcgccacaataaacggtaattgcgtggtcgcctctccgccgctgacggtaataccttcaataaacagcgatgctttacgaatatgacgcagcacatcgtcaatgctcatagtctgcgccattggcgttgcctgctgtgggcacattttcaggcaggtatcgcactgctcgcagacgtccgaccgccataccactttcccgccatcaatgctgagggcgtggtgcggacactgcgatacgcattccccgcagtcgttacagcgtcccatcgtccacgggttatggcaattcttgcagcgcaaattgcagccctgtaagaataatgccaggcggctgcctggcccatcgacgcaggaaaacgcaatgatcttactgactaaagcgcatctgttgttcatggctgactacgcgtggctgtcgttccaggatgcgggtattacgtgcggcttcttctcccagccaggtggtattcgtgcgcgagccttcggcgcgaaatttcgccagatccgacaggcgcaccatataaccggtgacgcgcaccagatcgttgccgctgacattggcggtaaattcccgcatcccggctttgaacgcgccaagacaaagctgaaccagcgcctgcggattgcgcttgatggtttcgtccagcgtcagaatgtcgctgatcccggcatgataaaaggcatggtgcggcgcgacggtttgcaaatgggtgatagggtccggttcatcgccatacggcagacgcgcgcccggcgtagtgccgatatcggaactgatgccagactgggcatggagcagcgcccgttgcttcctgccatacttcactggcgtattttcgacgaaatccgccagttgggcgctaatacggtagcccagctcgttcgccgtttcattcttgccgtaacgggcggtcaggccggcgttttcgcacagcaggttcacggcttccgccagcccgtacataccgaacatcggcgcaaaacgttcgggatcgatcaaaccttcctgtacaaggaagctattctcaaagaaatgtgacttttcatagaggaattcacatcgtgaattaatgatggcgatctgctgtcggcagtagtgcggtagcgtgcgtgaaaagaagtcatcgacagacgtactgcgttctgccacggctttcaggttgagacgtaccagcgtactgccaccgccggcaagcggtagcgagttataacaactgacgatgccataatggccttttgtgaaaattttatcatttacagggccgttggaaatgtgtggcttactgcattcgcaaatgtttttggcgacctccagcagcagatcgtccggcgtaatttccgcatcgtagataaacgtcaggttaggcgccacctgctttaactcggcatcggcgcgcaaaatcgctcgtgtgacaggcgtatcggcagggccaatattggcatgcataaaggcgtctggcagcgttctgtcgagataacgccagaaacgttttattcgaatatcgatcgcatcttgtgttagaattctaacatacggttgcagcaacgcatcaagctggccgagataaaccggcatggacgtcacggaaggaacgtgatgatacagaatggtgagtagggataacgcatcatccagatctttcgcgccttccagttccagccactgtgaaccgttagccagaaatcgggcgtaatcgggcaacacgtagcgcggtttgaagggggcgtgcccctcaaacatatcgcaaatgacgccttcatccagcgcctggcgggcatcttccggcagggtgggataaggcagggcgttttcagcttccagcgccagaaaatggcgtttttgttcaggcgtgagcaccgggctggtcacaatttgctggcaacgctgctggagcgcagtttcgcatgaggcaggcatcttcgtttcctctttatgccgggacgatgcgctattgtagaaaatggcggcaaaccgactttgatcctgatgcgcttaacgctcgaagaacaggcggtgacggcgggataatttgattcagatctcattacagtaatgcaaatttgtacgtagttttcattaactgtgatgtatatcgaagtgtaatcgcgagtgaatgttagaatattaacagactcgcaaggtgaaattttatacggcaatgccgttggagaatgtcatgactgatttaaaagcaagcagcctgcgtgcgctcaaactgatggatctgaccactctgaacgatgacgacaccaatgaaaaagtgatcgcgttgtgtcatcaggcaaaaaccccggtcgggaatacggcggcgatttgtatttacccgcgttttatcccgattgcgcgtaaaactctgaaagaacaaggtaccccggacatccgcattgcaacggtgactaacttcccgcatggcaatgatgacatcgatattgcgctggcggaaacccgtgcggcgatcgcctacggcgctgacgaagtggacgtggtattcccgtaccgcgcgttgatcgccggtaacgagcaggtgggttttgacctggtaaaagcctgtaaagacgcttgtgccgcagcgaacgtattgctgaaagtgattatcgaaaccggcgagctgaaagaagaggcgctgattcgtaaagcctctgaaatctccattaaagccggtgcggatttcatcaaaacctctaccggtaaagtgccggtaaacgctacgccggaaagcgcgcgcatcatgatggaagtgatccgcgacatgggcgtttccaaaaccgttggcttcaaaccggcgggcggcgtacgtacggcggaagacgcgcagaaattcctcgcgatcgcagacgaactgtttggcgctaactgggcagattctcgtcactaccgctttggcgcatccagcctgctggcaagcctgctgaaagcgctgggtcacggcgacggtaagagcgccagcagctactaagctctgatttgccggatggcgctgcgctttccggcctacaaatccaggcctgtaggccggataaggcgttagccgccatccggcgatgtaagccttctactcttttccctcaggagggtaccgtgtttctcgcacaagaaattattcgtaaaaagcgtgatggtcatgcgttgagtgacgaagaaattcgtttctttatcaatggtattcgtgacaatactatctctgaagggcagattgccgccctggcgatgaccatcttcttccacgatatgaccatgccggagcgtgtttcgctgaccatggcgatgcgggattccggtactgtccttgactggaaaagcctgaatctcaatggcccgattgtcgataagcattcgaccggcggcgtaggggacgtgacgtctctgatgctggggccaatggtagcggcctgcggcggttatgtgccgatgatctccggtcgcggtctcggacataccggcggtacgctcgacaaactggaagcgatcccgggcttcgacatcttcccggacgacaaccgtttccgcgaaattattcaagacgtgggtgtggcgattattgggcaaaccagctcgcttgcaccggcggacaaacgtttttacgccacccgcgatattaccgcgacggtggactctattccgctgatcactggttccatcctcgccaagaaactggccgaagggctggatgcgctggtaatggacgtcaaagtcggcagtggcgcgtttatgccaacctatgaactttctgaagcccttgctgaagcgattgttggcgtggcaaacggcgcgggagttcgcactacggctttgttaaccgatatgaaccaggtgctggcttcgagcgccggtaacgcggtggaagtgcgtgaagccgtgcagttcctgaccggagaataccgcaatccgcgcttgtttgacgttaccatggcgctatgcgtggagatgctgatctccggccagctggcgaaagacgacgccgaagcgcgtgcgaaattacaggcggttctggataacggtaaagcggcagaagtctttggtcgtatggtggccgcgcagaaagggccgagcgatttcgttgagaactacgataaatacctgccgaccgccatgttgagcaaagcggtatatgctgataccgaagggtttatcagcgcaatggatacgcgtgcgctggggatggcggtcgtctcgatgggcggcggccgtcgtcaggcgtctgataccattgattacagcgttggctttaccgacatggcccgtctgggcgacagcatcgacgggcagcgcccgctggcggtgattcatgccaaagacgaagccagttggcaggaagcggcgaaggccgtcaaagcggcaattatccttgacgataaagcgccagcaagcacaccttcggtctatcgtcgaattactgaatagttgtatactgatctgatcaattatttttgaagcactaagtacggagaagatatgaaacgtgcatttattatggtgctggactcattcggcatcggcgctactgaagacgcggatcgttttggcgacgtaggttccgacactctgggccacatcgcagaagcttgcgccaaaggcgaagctgacaatggccgtaagggcccgttgaatctgcctaacctgactcgtctggggctggtgaaagcgcatgaaggctctaccggtaaaattgccgccggcatggacggcaacgcggacgttattggcgcatacgcatgggcgcacgaactgtcctccggcaaagatacgccgtccggccactgggaaatcgccggcgtgccggtgctgttcgactggggctatttcagcgaccacgaaaacagcttcccgcaggaactgctggataagctggtaaaacgcgccaacctgccgggctatctcggtaactgccactcttccggtacggtcattctggaccagctcggcgaagagcacatgaaaaccggcaagccgattttttacacctccgctgactccgtgttccagattgcctgccacgaagagacctttggcctggataaactctacgagctgtgcgaaatcgcccgtgaagagctgaccgaaggcggctacaacattggccgcgtgatcgcgcgtccgtttatcggcgacaaggccggtaacttccagcgtaccggcaaccgtcacgacctggccgtagaaccgccagcgccgaccgtgctgcagaaactggtcgatgaaaaacagggccacgtggtgtccgtcggtaagattgccgacatctacgccaactgcggcatcactaagaaagtgaaagcgaccggtctggacgcgctgttcgacgcgaccctcaaagagatgaaagaagcgggcgataaaaccatcgttttcactaacttcgttgacttcgactcttcctggggccaccgtcgcgacatcgcgggctacgccgcaggtctggagctgtttgaccgccgtctgccggagctgatggagctggtgggtgaagatgacattctgatcctgaccgctgaccacggctgtgacccgagctggaccggtactgaccatacccgtgagcacattccggtgctgatctacggtccgaaagtcaaaccgggctctttaggtcaccgtgaaacctttgcggatatcggccagacgctggcgacctactttggtacatcgccgatggactacggtaaaaacatgctgtgatacccgttgtctttcgcgctgtagatgcgttgacttcattcgctcaccccggtcacatcgttaatctatgctcccggggattcacgaattcgtcgccttcctacaacgcgaaatccttagggtatttcactgtttttacacacgttttgtaggcctgataaggcgtagccgccatcaggcaataacaacaaatttaaagggaactgaagatggcaactccacatattaatgcagaaatgggtgatttcgctgacgtcgtattgatgccgggcgacccgctgcgtgcgaagcacattgctgagactttcctcgaagatgtccgcgaagtgaacaacgttcgcggcatgttaggtttcaccgggacttacaaaggccgtaagatctccgtgatgggccacggtatgggtatcccgtcctgctccatctacaccaaagagctgatcaccgatttcggcgtgaagaaaatcattcgcgtcggctcctgcggcgctgtgcgcatggacgtcaaactgcgtgacgtggtgatcggtatgggggcctgcaccgactccaaagtgaaccgtatccgtttcaaagatcatgactttgcggctatcgctgacttcgacatggtacgtaacgcggttgacgcggcaaaagcgctgggcgtagacgcgcgcgtgggcaacctgttctccgcggatctgttctattctccggacggcgaaatgttcgacgtgatggaaaaatacggcgtactgggcgtagagatggaagcggcgggtatctacggcgttgcggctgaatttggcgcgaaagcgctgaccatctgcaccgtgtctgaccatatccgtacccacgagcagaccactgccgctgaacgtcagacgaccttcaacgacatgatcaaaatcgcgctggaatccgtactgctgggcgataaagagtaagattgtgctgtgcccggtggcgcttcgcttaccgggcctacaacggcctgcgattgttacaggatcgatttgtaggctggataaggcgtagccgccatccggcaatctgctgtttatactgcgagcctcattcccgaattaccctctccgcattgccttttgctattaacccgttacgtttggattttgtttaaggaatgaacaaaatgtcgaactatcgtcgttattacattaacggtggaacctggtttttcacggttaatctgaaaaaccggaaaagtgatttacttgtccgccagattgcggaattacgctctgcgattcgccgagtgaaaaatacgaagccttttcaaattgatgcttttgtcgtgttgcctgagcatctgcattgcatctggacgcttcctgagaacgattgtgacttttcatctcgctggcgggagcttaaaaagttatttaccaaatcgataatgcgccatgacgtgtggcagccacgattctgggagcacacgattcgcgacgaaaaggattttcgccgacatgtcgattacctctacttcaaccccgtgaagcacggttgggtaaggcgggtgcaggattggccgttttcgacctttcatcgtgatgttcgcaatggcgtttacccggttgattgggcgggggaggtgagggatcttgacgctggtgaatagcggtaatgccggatggcgcgttgcttatccggcctacagaaagcactcatttgtaggccggataaggcgtagccgccatccggcaattctttaacgcacggcccctgcgacccaattcgccagttcccgcaactcactctcctgttccggaaacgtcgctatcagcgcttcgcacgtttcctgtagtttatccgcccgatactggcagccttgcagccgccccgccagcgcttccagcggtgccgggttcaggctatcggtaaacgcctgtgcgcgagtaatcacacctttctctacgtcaaaatgcagctcgacgccgccccaggtgaaacgctcgtccagcagatggctgaacgccggtgcctggccgaaattccactcccaactgctctggcgcgcaaaggtttcggtaaaattcggcagatccggcgttttatccggtgaaatcacttccgcgtcgatgcgttcgccgtaatgggcgaaaaaggcttccgtgaccgcctggcagacctgttcatgggtgatacccggtaataactcggtaagattggctacgcgggagcgaacggaggtgattcctttcgccgcaagtttctttttatccggattcagatagtttgccagacggctgaggtcggcgttcagcagcagcgtaccgtgatggaagccgcgatctttggtttcgcgataggctgaaccggagactttgcgatcgccgtccggcgtttttacgaccagatcgttgcgtcctgaagcatcggccatgacgcccagcgaattcagcgccgcgagcacaatatgggtggagatggttttatcgtattccggtttaccggccataaaggtaaagcaggtattaccgaggtcatggaataccgcgccgccgccactgctacggcgggccagacggacgttatcttcttccatacgccgcgtattacactctttccacgggttttgcgcgcgtccaatgaccaccgtgtccgcgttgcgccacaggaacagcacgcgctgggtggcgggcatctggcggaaaatgcactcctcgaccgccaggttaaaccagggatcgtaagagtcagaaataagcaggcgtaatgttgtcatggtggttttccttacctttattaagccgtcattttactctttttcctcacgctcttcctcttccggaacaggcttgctggccgttaacaggaagggtgactgctgccagcgggtgcgtttaccttgtagcaaggtgcgcgtcagcaccacgcctatcgccagcgagagtagcagcatcaggcgtagaatgttggtggtgttatcgacctgttttgcttcggtggccagagtgtgggtatccagcgtcagacgcaggtagcccaatgggccgtttttcccctggataggctcgacaatttgttggttaaaatagctgcccgcttttttgccatccagcgccagcctgtcgcgcacgttgacgctttcgccagcgcgagtaataagatcgccctgttcatcatagacgccggcatccagaatacggctctcttgcgtgagctgacgcagcacggcgttgatgcgattttcatccggtgtttcgctgcgcatcagcggggcgatgttgagcgtcacctggcgcgccagcgtgcgggccagctcttccagctgtggattgcgctgtcgctggtggttttgactaaaccaggacgcgccctgcatgagcgcgacgagcagtgtgagacagaacaatacaatgactgcacgatgcagccgaaatttcagttttgcgcgagccatattccacctgctgaaaatttgaggcttaatgttgccagaagcgatggttacaaggtagcctcatgcgttattttccgcggggcggttaccggcctgaacgatttacaggagctttaatgcctaacattacctggtgcgatctgcctgaagatgtctctttatggcctggtttgcctctttctttaagcggcgacgaggtgatgcctctggattaccatgcaggccgcagcggttggctgctgtatgggcgcgggctggataagcagcgtttaactcaatatcagaccaaactgggcgcggcaatggtgattgtcgccgcctggtgcgtggaggattatcaggtcattcgtctggcggggtcgctgacgccgcgtgcgacgcggctggcgcatgaggcgcagctggatgtcgcgccgctgggtaaaattccgcatttgcgcacgccggggctgctggtcatggatatggattccacggcgatccagattgagtgtatcgatgaaatcgctaagctggccggtaccggtgagaaggtggctgaagtgacggagcgcgcgatgcgcggcgagcttgattttaccgccagcctgcgcagccgcgtggcgacgctgaaaggcgcggatgccgatattttgcgccaggtgcgcgggaatctgccgctaatgccaggattaacgcagttggtgctaaaactggaagcgctcggctggaaaatcgctatcgcctccggcggcttcactttcttcgccgactatctgcgtgaccagctacgcctgacggcggcggtcgccaatgagctggagatcatggacggtaaatttaccggtcacgttatcggcgatattgtggatgctgagtataaagccaataccttgcttcgtctggcgcaagagcatgacatcccgctggcgcagacggtggcgattggcgacggcgctaacgatctgccaatgatcaaagcggcagggttaggtattgccttccatgccaagccaaaagtaaacgaaaagacggagattacgatccgccacgctgacctgatgggcgtgttttgcattctctccggcagcatgaaccagaaatgattaatctgcccaatggcaaggcgaccgtaggccggataagcgccagcgccatccggcaacagcgttaacgaaagaggtaaaacgtggcaaaagctcccaaacgcgcctttgtttgtaatgaatgtggtgccgattacccacgctggcaggggcagtgcagcgcctgccaggcctggaacaccattactgaggtgcgccttgccgcgtcgccgacggtggcgcgtaacgaacgtctgagcggatacgccggcagtgcgggcgtatcaaaagtgcagaaactgtctgacatcagtcttgaggaactgccgcgcttttctaccggttttaaagagtttgaccgcgtgctgggcggcggggtggtacccggcagcgccattttgattggcggtaaccccggcgcgggcaaatcaacgttgctgctgcaaacgctgtgcaaacttgccgagcagatgaaaacgctgtacgtcaccggcgaagagtcgctacagcaggtggcgatgcgcgcgcaccgtctcggcctgccgaccgctaatctgaatatgctctccgaaaccagcatcgagcagatctgcctgatagcggaagaagaacagccgaagctaatggtgatcgactccatacaggtgatgcatatggcggacatccagtcgtcgccgggcagcgtcgcccaggtccgcgaaacggcagcctacctgacgcgcttcgctaaaacgcgcggcgtggcgatcgtgatggtcggccacgtcaccaaagacgggtcgctggcggggccgaaagtgctggaacactgtattgattgctcagtattgctcgacggcgacgccgattctcgtttccgcacgctgcgcagccacaaaaaccgctttggcgcagtcaatgagctgggcgtcttcgctatgaccgaacaggggttgcgcgaagtgagcaatccgtccgccatctttttaagccgcggcgatgaggtcacttccggcagctcagtgatggtcgtctgggaaggtacgcgaccgttgctggtggagattcaggcactggtcgatcactcgatgatggcgaaccccagacgcgtggcggtcggtctggaacaaaaccgtctggctatcctgctggcggtgctgcaccgacacggcggtctgcaaatgtcggatcaggacgtcttcgtcaacgtggtcggcggcgtgaaagtcaccgaaaccagcgcggatctggctttactgctggcgatggtctccagcctgcgtgacaggccgttgccgcaggatctggtggtgtttggcgaagtggggctggcaggcgagattcgtccggtgccgagcgggcaggagcgtatttccgaggcggcgaaacacggttttcgtcgggcgattgtgcctgccgccaacgtaccgaaaaagccgccggaaggaatgcaggtgttcggtgttaaaaagctcgcagatgcgttaagcgtgtttgacgacttataattctctgtatgtagtgatgttgtataatttgccggatggcgacgcaatgcgtcttatccggcctacggattgatacggattgatgttgtaggcctgataagcgaagcgccgtcaggcagtgttatgcgatttttccagcaggaggctcttgtgtcatcgttcgactatctcaaaaccgcgattaagcagcaaggttgcactctgcaacaggtggctgacgccagcggtatgaccaaggggtatctgagtcagttacttaacgccaaaatcaaaagccccagcgcgcaaaaactggaggcgctacaccgttttctcgggctggagtttccccgccgacagaaaaacattggcgtggtgttcggtaaattttatccattgcataccgggcacatctacttgatccagcgtgcctgtagccaggtggatgagttgcacatcattatgggatatgacgatacgcgcgaccgcgggctgtttgaagatagcgccatgtcgcagcagcccaccgtgtcggatcgcctgcgctggttgctgcaaaccttcaaataccaaaaaaatattcgcatccacgcctttaatgaagaggggatggaaccttatccgcatggctgggacgtctggagcaacggcattaaagcgtttatggcagagaagggaatacagccgagctggatctacacttccgaagaggctgatgcgccgcagtacctggagcatttagggattgagacggtgctggtcgatcctgaacgcacgtttatgaatatcagcggggcgcaaatccgcgaaaatccgtttcgttactgggaatatattcctaccgaagtgaagccgtttttcgtgcgtaccgtcgcgattctgggcggggaatcaagcggcaagtctacgctggtcaataagctcgccaatatttttaataccaccagcgcctgggaatatggccgcgactatgtcttttcgcatctgggcggcgatgagatggcgttacagtattccgactacgataaaattgcgctgggtcatgcgcaatatattgattttgcagtgaaatatgcgaataaagtagcgtttatcgataccgatttcgtcaccacccaggcattttgcaaaaaatacgaagggcgcgagcatccgtttgtccaggcgctgatcgacgagtatcgcttcgacctggtgattttgctggagaataatacgccgtggatagctgacggactgcgaagcctgggcagttcagtggatcgcaaagcgttccagaacctgctggtcgagatgctgaaagaaaacaacattgagttcgttcacgttaaagaggctgattacgatggccgctttttgcgctgtgtggaactggtgaaagagatgatgggcgagcagggataagaaccaatgcctgatgcgacgcttaccgcgtcttatcaggcctacagtttcacaacgtattggaatcgctgggtttgtaggccgggtaagcgcaagcgccacccggcattcagacgtttatttggcaatacgcttgtacttgatacgcttcggctccagcgcctcggcgcccagagtgcgtttcttgtactcttcgtattcggtaaagttaccttcgaagaattccaccttaccttcatcctgataatccagaatgtgggtggcgatacggtcaaggaaccaacggtcgtgcgagataaccatcgcgcagccagggaactccagcagggcgttttccagcgcgcgcagggtttcgatatccaggtcgttcgtcggttcgtcgagcagcaggacgttgccgcccacctgcagcagcttcgccagatgcaaacgaccacgctcaccgccggacaattcgccaacgcgtttgccctgatcgacgcctttgaagttaaagcggcctacataggcgcggcttggcatttcggtgttgccgatcttcatgatatccagcccgccggacacctcttcccagacggttttgctgttgtccatcgcgtcgcggaactgatcgaccgaggccagcttgacggtttcacccagcgtaatggtgccgctatcaggctgctcctgaccggacatcatgcggaacagggtcgatttacccacgccgtttggcccgatgatcccgacgatagcgcctttcggtaccgagaagctcaggtcgtcgatcagtacgcggtcgccgtaggatttacgcaggttgctgacttcaatgactttgtcgcccagacgcggtcctggtggaataaacagttcgttggtttcgttacgtttctgatactcaacgctgttcagttcttcaaagcgagccagacgcgccttacctttcgactgacggcctttcgcgccctgacgcacccactccagctctttctcaatggatttacggcgcgccgcttcggcagacgcttcctgcgccagacgctgatctttctgctccagccaggaggagtagttgccttcccacggaataccttcgccgcggtcaagctccagaatccagccggcgacgttatcgaggaagtaacggtcgtgggtaatcgccacgacggtgccttcgaagtcgtgcaggaaacgttccagccacgcaacagattcggcatccaggtggttggtgggttcgtcgagcagcagcatgtccggcttttccagcaacagacggcacagcgccacgcggcggcgctcgccgccggacagtttttcgactttggcatcccagtccggcagacgcagggcgtcagcagcacgctcaagctgcacgttcaggttatgaccgtcgtgcgcctggataatctcttcaagccggccctgctctgcggccagcttgtcgaagtcggcatccggatcggcgtacagcgcgtacacttcatccagacgtttgagggcgttaaccacttccgaaacggcctcttcaatcgactcgcgtaccgtgtgttccgggtttagctgaggttcctgcggcaggtagccaatcttaatgccgggctgcgggcgcgcttcgccctcgatatctttatcgagacccgccatgatgcgcagcagggtagacttaccggcgccgttaaggcccagcacgccgattttggcgccagggaagaagctcagcgagatgtttttcagaatatgacgtttcggcggaaccactttgccgacacgatgcatggtataaacgaattgagccacgttggacttcgcctctatgtttatcgtgatggtgaatagatttcaaaggcgaagtgtagcctttttccctgcctaagcccagccagcagatcgcactcgcaataaaagtaaaaaagtgtccgtaacgtggcgcaaatggctatgactggttagcataaattcattacgcggcatgatgctgcattggataacaattgaggaagtgcttgtggatagagccaaaccatttgtctggcgtctcgtcgccgccagcgtatgcctgttgaccttttgtcacctcgcgcgggccgactcactggaagagcagcgtaaccgctatgcgcagattaagcaggcctgggacaaccgccagatggatgtggtagagcagatgatgccgggtctgaaagattatccgctctacccgtatctggaataccgtaagatcaccgacgatttgatgaaccaaccggcgattgccgtcacgcagtttgtgcgcgccaatcctacgcttccgcctgcgcgtacgctgcaatcgcgcttcgtcaatgagctggcgcgtcgtgaagactggcgcggcttgctggcgtttagcccggagaaacccggcaccacggaagcgcaatgtaactattactacgcgaaatggagtaccgggcaaacggaagcggcctggcagggcgcgaaagacctttggctgaccggcaaaagtcagccgaatgcctgcgataaactgttcagcgtctggcgggcctccggcaagcaagacccgctggcgtatctggaacgtattcggctggcgatgaaagccggaaatacggggctggttacggtgctggccggacagatgccggcggaatatcaaacgatcgcctcagcgatcattaccctcgctaatgaccctaataacgtgttgacctttgcacgcaccaccggcgccaccgattttacccgccagatggcggaagtcgcgtttgccagcgtcgcccgccaggacgcggaaaatgcgcgtctgatgatcccctcgctggtacaggcgcagaaacttaatgaggaacaaacgcaggcgctgcgcgatatcgttgcctggcgactgatgggcaacgatgtgaccgatgcgcaggcgaaatggcgcgatgacgcgattatgcgctcgcaatcgacgtcgcttatcgagcggcgcgtgcgtatggcgctggggatgggcgatcgtcgcggtctcaatacctggcttgcccgcctgccgatggaggcgaaagagaaagacgagtggcgttactggcaggcggatttattgctggagcgcggtcgtgacgccgaagcgaaagagatccttcatgctttaatgcagaagcgcggtttttatccgatggtcgcggcgcagcgtttaggcgaagagtacacgcttaaaatcgataaagcgcccgccaacgtaaacagcgcgttgacgcaggggccggagatggcgcgtgtacgggagctgatgtactggaacctggataacacggcgcgcagcgaatgggcgaatctggtaaaaagccgtagtaaatctgaacaggcgcagctggcgcgctatgcgtttaaccagcactggtgggatctgagcgtacaggcgacgatcgccggaaaactgtgggatcatctggaggagcgtttcccgctggcgtataacgatctttttacccgctatacccgcggaaaagatatctcacaaagctatgccatggcgattgcccgccaggagagcgcctggaacccgaaagtaaaatcaccggtaggggccagcggtttaatgcagattatgccgggaacggccacccatacggtgaaaatgttttcgattccggactaccgcggccccggccaactgctggagccggagaccaacatcaacattggcaccagctatttgcagtatgtctatcagcagtttggtaataaccgcatttttgcatcggcggcgtataacgccgggccgggacgcgtgcgcacctggcttggcaatagcgccgggcgtatcgatgccgtagcgtttgtcgaaagcattcccttttcggaaacgcgcggctacgtgaaaaacgttctggcctatgacgcttactatcgccactttatgggacagaaagaggccttaatgagcgactctgagtggcagcgacggtattaatgcagacgggttatgttatcatttgtactcgtgtaacagtacaaacggcggtataacatgacccagcattccccttattcatcggctatcgccgaacaacgtaatcaggagtggcttcgttttgtggagttactccgtcaggcatatgcagaggatctgcatctgcctttattacaactgatgcttacgccggacgagcgtgaagcgctgggaacgcgcgtgcgcattattgaggagttgctgcgtggcgaaatgagccagcgcgagttgaaaaccgagctgggggcgggcatcgctaccatcacacgcgggtcaaacagcctgaaatccgcgccggttgaactgcgtcattggcttgagcagatactgctgaaaagcgcctgatttgctcgtaggccggataagacgaagcggccatccggcaacatcgccgcgaaatgcctgatggcgctgtgcttatcaggcctacaacatagcgcaaataattatcgatacaccgcgttatgaaacgggctgagcgccaggatcaccgcctggtagtaaacgctggagcgcgttaattttccggcggtaaatacgccaatggcgccctctttgcgaccaatccagaaatcagcttgtggatgcaggcgtcgcgcattacccacgcgatttcgtgcgccagcacgcgtttcctcgcttccgaagggctgctccggtacgccgctctcgacggcgacgggtgtaatatggcacgatccttcgccgaaaatctcttcaaatgcctgtagaattgcctgaattttggcaggattggtggtcgcagagataacctggtgcataattaagctcagttttaaaaatttatcgcagtataacggaaaaaaacatgttacaggtataccttgttcgccacggtgaaacgcagtggaacgccgagcgacgtattcagggccaatcggacagtcccctgacggcaaaaggagagcagcaggccatgcaggtaggagaacgcgcccgcagcctcggcatcacccatatcatcagcagcgatttaggccgcacaaaacgcacggcggagattatcgcccaggcgtgcgggtgtgatattacctttgacttccgcctgcgcgagctggatatgggcgtgctggaaaagcgccagatcgattcgctgacggaagaagaagagggctggcgtcgtcagctggtcaacggcacgcaggatggccgcattcctggtggggaatcgatgcaggagttgagcgatcgcgttcatgccgcgctggcgtcctgtctggagctaccgcagggcagccgacctttattggtcagtcacggtatcgcgttgggctgtctggtcagtactatcctgggactacccgcctgggcggaacgccggttacgtttgcgcaactgctctatttcccgtatcgattaccaggaaagtcagtggctggcgtctggctgggtggtagaaaccgcaggggacgtttcgcatctggacacccctgcattggatgagctacagcgttaacggcgaatcgggatcagaaattcgcagcgcaggttgatagggcgatcgccggttttggtatcttctgacgggtagtatcgctctatatcctgccctttacgacgggtcagattcagcattggcatacaggtgccgtaaacggtcaggataaaatcctgcacgccggttcctaacccttcataggtgaacatgacgtattcacctccctgcaacagcacgggatgcgccgactgaacatagccatcggcctgctcttgcggcagtgcggtggtatagaatacttcctgctcatcgtctttctccatgctggggcgcgtttcattaagcccataaagcactggtggaatagttggcgaatgaccgaggaaatcatgccagaattgcacgcgcatttcgtggcggaagtcggaaatctgttccagcgagcaggaatagctctgcgtgacgccaagcagcggcgtatcttccagcgtaacgaactgatgttccggcacggtaaactcgcccagccgtaatggcgggcgaatgccaaaggcgctccattccggggagcgacgatacaacgctggcgtctgggaaaactgtttcttaaaggcgcgcgtaaaggtttgctgagaatcgaagcggtactgaagagcaatatccagaattggacgcgcggttaaacgcagcgccactgctgatttcgataaacgacgggcgcggatataagcgccaatagcgtggcccgtcacgtccttaaacattctctgtaggtgccacttggaatagcctgcttttgccgccacattgtcaagtgacagcggctgatccagatgaccttccagccagattaacaggtcgcgaattatgccagcctgatccataaaatatccccatcctttcaacaacgagcacccgatatcaggtaagaggataatagcattttttgttcttttagcattcagtgttttttttgagcttaaatgctttttttaggcaacgtgacaggtaattattctaatcctgtgatctataaccattttattttagaatgtctaataattacgcaacgtagcttttatgaatggtaacaatatgaaatacaagagcttagtacttttctcaattttgttgctgctggggcagagcgcccgcgcggaacaaattggttcagtcgatacggtatttaaaatgttcggccctgaccataaaatcgtggtggaagcttttgacgatcctgatgtcaaaaacgtgacgtgctatgttagccgggcgaaaacgggcggcataaaaggcggattggggctggcggaagatacgtctgacgccgctatctcttgtcagcaggtcgggcctattgaactgagcgacaaaattaagaacggcaaggcgcagggagaggtggttttcaaaaaacgcacctcattgatatttaagtcattacaggtcgtacgtttctatgatgagaaacgcaacacgctggcgtatctggcctactccgacaaagtggtcgacgggtcgccgaagaacgccatcagcgcggtgccggtcatgccgtggcgacaataacagggaaagcgtatgcagcaaccgcaggtctggttagtcgaggatgaacagggaatcgccgatacgctcatctacaccctgcaactggaagggtttaccgttgagctattcgctcgcgggctgcccgcgctggaaaaagcgcgtcagcaacggccagatgcggtgattctcgatgtgggactaccggatatcagcggctttgagctgtgtcggcagttgctggagcgtcatccggcgctgccgattcttttcctgactgcccgtagcgatgaagtggatcgattgcttggtctggagatcggcgcagatgattatgtcgccaagccgttctcgccgcgcgaagtgagcgcccgcgtgcgcacgctgctgcgccgggtgaaaaagtttgctgcgccgtcgccggtggtgcgtaccggacattttgatctcaatgaaccggcggcgcagatcgcctggtttggtacgccgctctcgctgacgcgttatgagtttctgctccttaaaaccctgctgctgtcgccggagcgcgtgtactcgtgccagcaattgatggatattgtctggtctgatgcccaagagaccttcgatcggacggtcgatacgcacatcaaaaccctgcgcgctaaactacgcgcgatcaacccggatctctcgccaattaacacgcatcgtggaatgggatacagcctgaggagcatctgatgcgcatcggaatgcgtttgctgctgggctactttcttattgtcgccgtcgccgccgtgtttgtgctgtctatctttgttcaggagataaagccgggcgtccgccgcgcgacggaagggacgctgattgacaccgcgacgctgctggcggcgctggcccgcgacgatctcctttccggcaacccgactgacggccagttggcgaaagcattcgcccagctgcaacatcgcccgtttcgcgccaatatcagcgggatcgtcaaagtgcgtaatgaataccatgtctacatgacggatgcgcaggggaaggtgttgtttgattcggaaaacaaagcggtggggcaggattattctcgctggaatgacgtctggcttacgttgcgcggacagtatggcgcccgcagcacggcaaaagattctgccgatcccaatagcaccgtgatgtacgtagccgcgccgataatcagcgatggacggatcatcggcgtcctgactgtcggcaaaccgaatgcggcaatggcgccggtgattaagcgcagcgaacggcgcattctgtgggccagcgccgttttactgggaattgcgctggcgattggcgcggggatggtctggtggattaaccgctccatcgcccggttgacgcgctatgcggattccgtcaccgaaaaccgcccgcttgcgttacctgcattaggcagcagcgagctgcgtaaactggcgcaggcgctggagagtatgcgcattaagctggaaggcaagaatgacattgagcagtacgtgtatgcgttgactcatgagctgaaaagtccgctggcggcgatacgcggcgcggcggagattctgcgtgaaggaccgcccgcggatgtggttacccgctttacagagaatatactggcgcaaaatacgcgaatgcaggcgctggtagaaaccctgctgcgccaggcgcggctggaaaaccgacaggatatccctctcgcgccggttgctgttgatgagctatttacgcagcttagcgaggcgcgcagtattcagttggcggcaaaaaagatcacgcttactctacgtccttcctcgctggttgtcgtcgccgacgcggagcttctggcgcaggcgctgggcaatgtgttggacaatgccatcgactttatgcctgaaaatggcgttatcacattaagcgctcagccgatgggagagaaagcgatcctgcaggtgacggattccggctgtggtattcctgattttgcgctgccgcgcattttcgaccgattctattcgttgccccgtgaaaacgggcgtaaaagcagcgggcttgggctggcgtttgtcagcgaggcggcgcggctcctcaacggtgaggtgacgttgtgcaaccgtcccgaaggcggcgtgctggcctcgttgacacttcaccgtcacttcacataacttcaaattctccccacatcgcgttcttacactgctggcattgcaaaggagaacgctatgttgaaatcccccctgttgtggaaaatgattacgttaggcggcgccatgatcctgctgttaattcccctgatgatggtacggcacaccatcgtggagcgtgctgattatcgaagccatgtagaagccgctattcgtcagagtaccagcggcccgcaaaaggttgtcggcccgctggtggcggttccggtgacagagctctataccgtgctggaagaggagaaagaggttcagtataagcgcagctatctctatttttggctgccggagtcgctattggtcgaaggcaatcaaaacgttgaagcgcgaaaaataggtatttatcaggggcaggtgtggcataccgatatggcgataaaggcagagtttgatgtggcccgtctgcatgagctgaacagaccgaatattacccttggaaagccctttatcgtcgtgggcgtcggcgatgcgcgcggtatcagcgcagtaaaagcgccgcaggtgaatggtgaaatgctcactgtagaaccggggaccggcttaccggaaagtagagagggcattcatatcccgctaccggacagtcagtgggcgacgcgcaacctgacgttggcgatgtcgttaaatttaagcggaaccggcagcttttcactggttcctgtcgggcgtagcagtgaaatgaccctgaccagtaactggccgcacccaaattttgtgggggattttcttcccggtaaacgcgaaatcagcggttcaggatttcaggctcagtggcaaaccagccggtttgccacgaatctcggcgaacagtttgctgatgcgcaaaaggtggattgggacaacttaccggcgtttagcgtcgctgtatcgacgccagccgatcagtatcaactgacggacagagcgacgaaatatgccattttgttgattacgctaacgtttatggctttctttgtcttcgaaaccctgacgggacagcgattacacccgatgcagtatctgctggtagggttatcgctggtgatgttctacctgctgttgctggcactgtcggaacatatcggtttcacgccagcctggatcgccgcaagcctagtgggcgcgttgatgaatagcgtttatttgcaggcggtactgaaaggatggcgcaatagcgtgctgtttacgttagcgttattggcgctggatggcgtgatgtgggggttactgcgttcggaagatagctcgttgcttctgggtaccggcgttctgctactggcgcttggcggcgtgatgttcctgacgcgccatctggactggtattcgctctcttgtcagcaacgtaagtcattaccgccagtaaaagatgacgaattacgtttgtggaaataaatctaacgggcgcgcgcgttaacgttttcccgcgcagcgccagaaaatgtgatgccgtcagttataggtcaggtttaatgttgccgtggcattcgcttgcccggccgttaccgtggcggcggttttatagtagcgcgcgctaattttcagggtggtcgacatattcatggttccgccgttaaccgtctggctgccatcggcattggtggtaatcgtgtgagtaaagagatcaattttttgattgattggcaaactgtcggtaaagaaaccagagtccggcgcctgaatacccaactgtacgccaacgccggttgcgctggttggcgcgcttgcattgctcaactggatgactgaattatcagggttatttccgctggccggttgggcgcttaacgatgcggagatagcggtgccttgttcgcaggtcaataagatatcctgcttgcctgtgcccgcggtttgactgttagcgaaactgcctaaattgacgctgcctaaatcaacggtgatggcaggtgtttctacccgacatcccatcgctttcatgatcaattgcgtattacccaaatacagatgggtcaggatatcgccgccagagctttccgttgcgctatcgcgaaaggatacacgtgccagtgggctttggaatgtcgcggtaccggaggtgatcggaccgcctaaggcgaccagttcaacattgtaggcgggggccatcgcatggtgggttttattgccatcgccattatggtacgtattatcgattggcatgacattatcgtaagggccagcattcgtttgggttttaatcgcaatgcccacgccggaaatcccggtgctaaataccggcgtgttgttcccgtcattcgcattgattgtcgcggatgtatttgactgcgcgctaccgggttcatataaaaaccgaccttataatcgcgactacagccatccattgtgacttcggaggtggaaacccagcccgattgccacaacacttcgcctgcggtataggcgtggctatccaccacaagctgcgacggcggggtgatagtgatcgcgccttcattaccggaacgtttacaggaggcgtaactatgaccggaatacgcgaacagcagaataagcgccagatataaccttctcatgaaaaattcctgcttttatatcaggtgaaatagaaaaatattattgccatgcgatagtgatcgtcacaacggacgtgaaatcccctgccgtgacttttccatacggggtatacatccttgcggcgacaggcaaattggcttcatgggtattactgttgatatccaccgtgtaagtgacgttattggccagattaaccagacttttactgtccaggttaaaaagctgtaatcctaaatcctgcgccggattggccgcgctgtttgcgtaaatcgcagaagcataattcggatcgggataaggtacgccgttaaatgaaatcgcggcttttgtggtcgttgccgggcaattcgtcatttttatggtgaaaggaatggtggcggtattgccaccggccacagcgatatccgcccgggcatattgcccaagagagatcgtgtcaggtaccgtcacggtacacggatcggcataaattaatcccgtaacgttaatgtctacggcatctgcggtattgtatgccgcgctgatcgagggcgaccatgatgccagacccgtgaacgttaacagggcggctaatgcagcaaatctgttcatattcatcttttatcccaccagaatcactggcattgctcgtgtaagatttctacgccagaagcggagggggagctcggtatacgataagagacctgacaccggtctgctgctgttggcccccacttcactaataaccgcccttgtttttccagtccggttaaccaggcttgccccgcatcaccaacaaaactgctgtgattgtctggttttgttaaagacgagacggtcgcgccaaaaggaacaggcagattgtttatgcgggttaataccatcaatgccttgtagccaatattggttttatattcagccctgaccaccgcgccacgggtaggcaccagcgttttactggtatcaatgagctcaatattttttctaatgcctgtcgtatctaaagacacttcattacgatgataaggcgaagcattaggtacgacggcataaccccgaaaatcggtgtccacgcccgtttcgttattcacggggacacctgctgcgccaggggctttaaccaatatgatagtgtcgtccattggctgggatagtgtcaggccatttcgatgtagcagtacgccgccctgaacgccataattcaggcgacgcatatgattatcgtaactatacccgccgttaatatccgcatacgtcccgttataggttgcgctcacattaccgctggtggctttctcttgagaggaataaccttcctgaacgctccatgagagatttttctgtgccagcgctgtgccgtttaaaccgacagtatgcgtgatatcgccgtctttcgcggagttcatattgtaggtggcatacgttgacggcataaaggcatctaacggaatactaatattgattgaaatttgctggtcattactgtcttccgtatcgtcgtcttcatcctgagtattatcggcgttcagcgtataagaatagttaatgccatagcttacgttatgccatgtgttgttatagccaatacctaatgatgtggtatgagtgtcattccagtaatcttcattatataaagtgagtgaaatggaaccgtagataatgtcttgcgacaacgacaggtcggtgcgattgcggacatgatcatagtgactattatcgctataggtatccagcacatcctcaagagcgtagtaatctttggtcgaataacggtaaccggcgacagtaaaattggtgcctgttgactgaatatctttgctgtaacgaatacgccaggactgtccggtaagcgtatcgctaaccacatcgcctgctttaatttttgaccatgagttggtgacgtctaaagacaatgcgcccagatcgccaaggtttaagcctgtcccgatgagcgccgcatgataaacatcattgctcagcgtactctctattccgccataggcggttacgccgcctgctaatccgtataaggccgtcagttctgcgaaattctgttgcgcggaatgcgtatctgatgaacgcgtgcggcctaccgtcaagtcgtatttcaggtggccttcacgctgtaataccggaacgctggcgtagggcacaatgaaatgctgttcagaaccatcggattctttgatggtgacgtacagatcgcccgaaccgccggttggataaagatcgttgatggcgaatgggcccgccggaacgttagttttgtagatggtataaccgttttgttcaacggttacctgcgcgctgcttttggccaccccgcgaatgaccggggcgaaccctttcatactgtccggcaacatatcgtcatcagaagagatctgtacgcccttaaatgaaatactgtcaaagacgtctgcgggcgtgttattttccccggcgatcagctgtccttttaaaaattcgatatcgcgagaaacataggtgtaggcagaatcccagctattttgcccatcgctatcatgattccaggttgagtagttacgaaaacgccatgcgccaatgttaataccagggcgcaggttagcgtattcgctattttccgtccggttttcatcaatatcgtgatcctgcgatccggtaaaactgtagttcagcaaaaaagcattaatgccttcatcccatttgctggtagggacgaattctcgcgggtcggcgatcaacgcgatttgagggatcgctaaatccagccggttaccgatgacattaaactttgctacagcgccagccagcagactaagatcggtacacccgtttgggtcatttttaagctcggggaagttttctgtttttacgccccactgcttgagttgttcaacgctaagacatggctgtagggagagcttattatctgctgattttttatttttaaaggcaatattttttgtttcaacattagtgttattaatataaatatcaacattataggtgccttctgcctgccccccttttcgaaaaccgatagatcgacattctccacgcccggttcatcattttccaacgataatggattaaaatgatcatgcgctaacgctggttttatggatcagcatataaagagaaacgataacgctaattgagaacggggctctactctggagaattgcacagtaaaagtcctgaaagggtaaaagtaaagtgaagtcgttaatggctagaatgaaccggaatgcggctctaaactcatcccataatcgctgattaatcgccacgttaccgtaccatgaggggcggcagtcgaactcaatttaaatgacgctgatgattttggcggaacgaaggtcgctgatttcacttcatggctgttaagcgtcacactggcaaagttcatataatagggggtagggttatttacggtaataacatcccctgccgtctgccattttaattgttggctctggctatcaggcgttgatttggttaatgctggcggtcgataaataagctttatttgggtattaatggagatttccacgcggttcgcggaggcattatcatcaatagaaggaatacccttaatattgagccagtacatagactcccgatctgcaggtagaggggcgccagagcgaataacccgaatactgttcttttgcccggcatcaaggcgaaaaagaggcggggtgataataaacacctgcttatttgtgacctggggatcggcaaccgataaccatgactgaacaagattcgctttgctgtctttattctctacattgattgacgactcatcattattgccgtcgaaaaccagtcgggttccgccaacaacaatgctggcatgggcaacatggcttgtcagtaatacgaccaacacggatttctttatgtgtttcattttttactctgtaaagatgttttacgctatggactggcatcctgcctgtccacatcaggatgagaatgccttactgatacgaaacggtatacgtaacctgagtgctaacatctccaccggttacggttgcggaaccatcgtttgccatggcggcgtaataggtaaagtctgctgtcgagccgtcggttggcaggcttactgcggcatcatccgtgttatctgtcacatcgctatgtgaagcgttctgaatagaaataccgacacccgcggcgcccgtttccgatccttcgtccgcgtttttgaagtacgttgggttggaatcatctgttgcgccgtggaagcggaacatggcctgggtcggtacgccagtccctgcttccgggcagctaaccaggcttacggtaaacggcacgtaatcggttgtggcgcctttttccgcgatgcgttctttgctgtaattacctaaatcaatggtggtatccgtggagccattaacctgaaccgtacacgcctgatcgtaaattttgccattgaacgtaatcgtgttctgggcaaataccggtgtggatgctacggcagttaacattgccaggatgataattttcttattaaacatattaattgttgcctgattctattcgctgaaaaataaagatagctatataaaataaaatattatattttactctgtatgcgcttctttctgttctgtagataagcaggcggctattctacgtatatcaactatgaactcaataaaaattctgatgcaatattgaacggcagtccagtttcggacccggtaacaaagtttaataaaataccactaaagaagtacggtagatgactggatttatagagcaagatctcttttttgataatagttattatttcctggaggatttatttaactctatattgctttatttttaataatatacgacgcttgttcatttaaaatgaaaccggcaggtttcgaagctctaacagtcttccatgcagtatttttatatagttccccgcttttaattctgaaagtacctgcatgatacggctgcgtgaaagcccggttctctgctgtatgaagttctgtgcgttgatctcaaatcgtgagctttcaggatacgaccacagttcaagtaacagcgcttttatctggctataggcgtcctgcccgataaggtttctgtcacggttactcatgaaagcaatgcggtacatcaggatgttcgaaatgtcacgccagagatgcttttcatcggctatttccacaaaatcttttactgggacaggataatattcacaggtggtttcggcgataaaaaagacgtctgaattctcttctaactggtataagtcggcataggcatctacaaggcctaaaatcattggcgagacaccacagcccattacaatactgtcgatacgccgacatactttaatagcgcctttagtgattaacaggatgtgggattgattatcaatcttgatatccagggttttaccggccgtaatagtgacaggggagatgttttgaataacgtgccgatgaatatttaaaatggcttgcaggtttttttctttccctgtgggacgatacacattcccgccgtttaactgcttcatatcttccccattattatggctgataaagtggttgactattaaaaggtaaacataaatttaatattcacttaaattataattaagtaaattaaaatagccaacaagaatatttaagtcaatgtattcaccttatcaatgcatgagcgacaacgctgtttttaaggttaaccatagtaaatgtgatgattttatttgcaatcattttatgacagctatcataggtaccgtgcttaacgagcgcgtagagcgtacaggatagcgaagcgatgaacatcgctgttggaggatacgaatgagagaaaagtacaaaatgcaagcgggcggcgttttactgagcgaaatcgccgcctgccggaactcctcccgtcgggagccataagcggttagcggtactggacgatcaggctttgaatctccggatgatcttttaacgacacgtgccgtaccgtggcgattccattcatcaacgaaatagcgtttccagacggtgtggcgactgtctgcaaatgggggattccgcaaacatgatacctcgatattgcgatcgtgaggcgcaagattacaaccatattcgacaatctggcctttgaaatgaataacgcctgcggagaccggcgcggtagcagccagcgcggctgatgaagctgacatcgctgcacaaaacaggtagcagcataatggtgattttttcatcctgtgaaacctcacgtcctgtgagcatccccttaatttttggggaccaacaaatcccgtgtattactctttaatgtaaatacacaaactaccttaactttcgcaagctgagataaacagcgctatacgacaatttttatgtaaaagagtacgtcataacggcaggtcaggagggaaagcggggccgcttagcggaaggggagcataagaaacagccagtaagaataacttaccggctgtttttacggtttggcgcctgggccgaattaatcctgcaggtcgccgcagaagcgataaccttcgccgtgaatggtggcgatgatttccggcgtatccggcgtggattcgaaatgcttacgaatacgacgaatggtgacgtcaacagtacggtcatgcggcttcagctcgcgtccggtcatttttttcagcagctcggcacgagactgaattttgccagggttttcgcagaagtgcagcatcgcgcggaactcgctgcgcggtagtttatactgctcgccgtccgggccgatcagtgaacggctgttgatatccagttcccaaccgttgaacttatagctttcaacgctacgacgctcttcgctgacggtacccaggttcatggtacgggacagcaggttacgggcacggatggtcaattcgcgtggattaaacggtttggtgatgtaatcatccgcgccgatttcgaggccgagaattttgtcgacttcgttatcgcggcccgtcaggaacatcagcgcaacattagcctgctcacgcagttcacgcgctaacaggagaccgtttttccctggcagattgatatccatgatcaccaggttgatgtcatattcagagaggatctgatgcatttccgcgccatctgtcgcttcgaatacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgtcgcaaattaacatgatcggcgtaacatgactaaagtacgtaattgcgttcttgatgcactttccatcaacgtcaacaacatcattagcttggtcgtgggtactttccctctggacccgacagtgtcaaaaacggctgtcatcctaaccattttaacagcaacataacaggctaagacgtaccggacacctaataaaactacgcttcgttgacatatatcaagttcaattgtagcacgttaacagtttgatgaaatcatcgtagctaaatgctagctttcatcacaaatttgcaatattccaactagttacgtaagccaactaataaatgcgatgaatccaaagaacaggatctattttaaattaaattatcctaaataaacagcaggataacgatgttctgttaacataaacagcaatagtacagatacgcaatagtgtagcgtcttttacgaaatcaaaaatgctttttcagtgatatccgttaaaattttgtaaatttgcgaagcgtaatatgcttacaaacgccagctaatttcctgtaaattagtcaaaaagagtaatgaaatgcgtgtaacaatcgttcttgtcgctcccgccagagcggaaaatatcggcgcagccgcccgggctatgaagaccatgggatttactgacctgcgtattgtcgacagccaggcgcacctagagcccgctacccgttgggtcgcacatggatctggagatattattgataatattgaggttttccacacccttgccgacgcgctccacgatgtggattttaccgtagcgacgacagcccgcagccgggcaaaatttcattactacgcttcgcccgctgaactggttcccttattacaggaaaaatcacgctggatgcgtcatgccgcgctggtttttggccgtgaggattccggtctgaccaacgacgagctggcgctggcggatgtattgaccggcgtgccgatggcggcggattacccttcgctcaatctgggtcaggcggtcatggtgtattgctatcaattagcaggtttaatgcaacagaccccggaatccgttgatattgctgatgaatcgcagttacaggcgttacgcgcgcgccttttacgcctgctaaccactctggaggcggccgatgaccacaaattaaccgactggctacaacagcgaatcggcctgctgggacagcgagatacggcaatgttgcaccgtttggtccatgatattgaaaaaaaactaacaaaataacgtgttgtaatttttaaaataata
